(12) United States Patent
Gori

(10) Patent No.: US 11,390,884 B2
(45) Date of Patent: Jul. 19, 2022

(54) OPTIMIZED CRISPR/CAS9 SYSTEMS AND METHODS FOR GENE EDITING IN STEM CELLS

(71) Applicant: Editas Medicine, Inc., Cambridge, MA (US)

(72) Inventor: Jennifer Leah Gori, Jamaica Plain, MA (US)

(73) Assignee: Editas Medicine, Inc., Cambridge, MA (US)

( * ) Notice: Subject to any disclaimer, the term of this patent is extended or adjusted under 35 U.S.C. 154(b) by 0 days.

(21) Appl. No.: 15/572,896

(22) PCT Filed: May 6, 2016

(86) PCT No.: PCT/US2016/031366
§ 371 (c)(1),
(2) Date: Nov. 9, 2017

(87) PCT Pub. No.: WO2016/182959
PCT Pub. Date: Nov. 17, 2016

(65) Prior Publication Data
US 2018/0282762 A1 Oct. 4, 2018

Related U.S. Application Data

(60) Provisional application No. 62/279,020, filed on Jan. 15, 2016, provisional application No. 62/244,577, filed on Oct. 21, 2015, provisional application No. 62/220,648, filed on Sep. 18, 2015, provisional application No. 62/159,785, filed on May 11, 2015.

(51) Int. Cl.
| | |
|---|---|
| *C12N 15/87* | (2006.01) |
| *A61K 35/28* | (2015.01) |
| *C07K 14/315* | (2006.01) |
| *C12N 5/0789* | (2010.01) |
| *C12N 9/22* | (2006.01) |
| *A01K 67/027* | (2006.01) |
| *C12N 15/10* | (2006.01) |
| *A61K 35/17* | (2015.01) |
| *A61K 35/545* | (2015.01) |

(52) U.S. Cl.
CPC .......... *C12N 15/87* (2013.01); *A01K 67/0271* (2013.01); *A61K 35/17* (2013.01); *A61K 35/28* (2013.01); *A61K 35/545* (2013.01); *C07K 14/315* (2013.01); *C12N 5/0647* (2013.01); *C12N 9/22* (2013.01); *C12N 15/102* (2013.01); *A01K 2207/12* (2013.01); *C12N 2500/36* (2013.01); *C12N 2501/999* (2013.01); *C12N 2510/00* (2013.01); *C12N 2510/02* (2013.01)

(58) Field of Classification Search
CPC ........ C12N 15/87; C12N 5/0647; C12N 9/22; C12N 15/102; C12N 2500/36; C12N 2501/999; C12N 2510/00; C12N 2510/02; A01K 67/0271; A01K 2207/12; A61K 35/17; A61K 35/28; A61K 35/545; C07K 14/315

See application file for complete search history.

(56) References Cited

U.S. PATENT DOCUMENTS

| | | |
|---|---|---|
| 8,546,553 B2 | 10/2013 | Terns et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,023,649 B2 | 5/2015 | Mali et al. |
| 9,074,199 B1 | 7/2015 | Chavez et al. |

(Continued)

FOREIGN PATENT DOCUMENTS

| | | |
|---|---|---|
| JP | 2017-511132 A | 4/2017 |
| WO | WO-2007/025097 A2 | 3/2007 |

(Continued)

OTHER PUBLICATIONS

US 10,077,445 B2, 09/2018, Doudna et al. (withdrawn)

(Continued)

*Primary Examiner* — Peter Paras, Jr.
*Assistant Examiner* — David A Montanari
(74) *Attorney, Agent, or Firm* — McCarter & English, LLP; Maria Laccotripe Zacharakis; Marcie B. Clarke

(57) ABSTRACT

The methods and compositions described herein surprisingly increase CRISPR/Cas-mediated gene editing in stem cells by transiently treating the cells with a stem cell viability enhancer prior to and/or after contacting the cells with one or more CRISPR/Cas9 components. Further, this treatment also surprisingly results in increased engraftment of the stem cells into the target tissue of a subject. The present disclosure also provides one or more modified CRISPR/Cas9 components which, when used in combination with the stem cell viability enhancer, further increases the frequency of gene editing in stem cells, increases stem cell viability, and increases stem cell engraftment.

16 Claims, 67 Drawing Sheets

Specification includes a Sequence Listing.

(56) References Cited

U.S. PATENT DOCUMENTS

| | | |
|---|---|---|
| 9,234,213 B2 | 1/2016 | Wu |
| 9,260,723 B2 | 2/2016 | Mali et al. |
| 9,260,752 B1 | 2/2016 | May et al. |
| 9,267,135 B2 | 2/2016 | Church et al. |
| 9,322,037 B2 | 4/2016 | Liu et al. |
| 9,388,430 B2 | 7/2016 | Liu et al. |
| 9,404,098 B2 | 8/2016 | Terns et al. |
| 9,410,198 B2 | 8/2016 | May et al. |
| 9,422,553 B2 | 8/2016 | Terns et al. |
| 9,512,446 B1 | 12/2016 | Joung et al. |
| 9,567,603 B2 | 2/2017 | Joung et al. |
| 9,567,604 B2 | 2/2017 | Joung et al. |
| 9,587,252 B2 | 3/2017 | Church et al. |
| 9,616,090 B2 | 4/2017 | Conway et al. |
| 9,637,739 B2 | 5/2017 | Siksnys et al. |
| 9,663,782 B2 | 5/2017 | Yu et al. |
| 9,688,971 B2 | 6/2017 | Doudna et al. |
| 9,725,714 B2 | 8/2017 | May et al. |
| 9,738,908 B2 | 8/2017 | Wu |
| 9,752,132 B2 | 9/2017 | Joung et al. |
| 9,790,490 B2 | 10/2017 | Zhang et al. |
| 9,803,194 B2 | 10/2017 | May et al. |
| 9,809,814 B1 | 11/2017 | May et al. |
| 9,816,074 B2 | 11/2017 | Conway et al. |
| 9,822,370 B2 | 11/2017 | Musunuru et al. |
| 9,822,372 B2 | 11/2017 | Zhang et al. |
| 9,833,479 B2 | 12/2017 | Conway et al. |
| 9,840,713 B2 | 12/2017 | Zhang |
| 9,873,894 B2 | 1/2018 | Conway et al. |
| 9,879,269 B2 | 1/2018 | Barrangou et al. |
| 9,885,026 B2 | 2/2018 | Brouns et al. |
| 9,902,974 B2 | 2/2018 | Conway et al. |
| 9,909,122 B2 | 3/2018 | May et al. |
| 9,926,545 B2 | 3/2018 | Joung et al. |
| 9,926,546 B2 | 3/2018 | Joung et al. |
| 9,944,912 B2 | 4/2018 | Joung et al. |
| 9,957,501 B2 | 5/2018 | Reik et al. |
| 9,957,526 B2 | 5/2018 | Holmes et al. |
| 9,963,689 B2 | 5/2018 | Doudna et al. |
| 9,970,001 B2 | 5/2018 | Miller |
| 9,970,024 B2 | 5/2018 | Church et al. |
| 10,066,233 B2 | 9/2018 | Barrangou et al. |
| 10,077,453 B2 | 9/2018 | Liu et al. |
| 10,093,910 B2 | 10/2018 | Joung et al. |
| 10,100,291 B2 | 10/2018 | Chavez et al. |
| 10,113,167 B2 | 10/2018 | Doudna et al. |
| 10,113,179 B2 | 10/2018 | Begemann et al. |
| 10,113,207 B2 | 10/2018 | Wang |
| 10,119,133 B2 | 11/2018 | Joung et al. |
| 10,125,361 B2 | 11/2018 | May et al. |
| 2010/0076057 A1 | 3/2010 | Sontheimer et al. |
| 2010/0093617 A1 | 4/2010 | Barrangou et al. |
| 2013/0011828 A1 | 1/2013 | Barrangou et al. |
| 2014/0068797 A1 | 3/2014 | Doudna et al. |
| 2014/0093941 A1 | 4/2014 | Terns et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0199767 A1 | 7/2014 | Barrangou et al. |
| 2014/0242664 A1 | 8/2014 | Zhang et al. |
| 2014/0242699 A1 | 8/2014 | Zhang |
| 2014/0256046 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273233 A1 | 9/2014 | Chen et al. |
| 2014/0287938 A1 | 9/2014 | Zhang et al. |
| 2014/0294773 A1 | 10/2014 | Brouns et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356956 A1 | 12/2014 | Church et al. |
| 2014/0357523 A1 | 12/2014 | Zeiner et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0024500 A1 | 1/2015 | Yu et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0071889 A1 | 3/2015 | Musunuru et al. |
| 2015/0071898 A1 | 3/2015 | Liu et al. |
| 2015/0071899 A1 | 3/2015 | Liu et al. |
| 2015/0079681 A1 | 3/2015 | Zhang |
| 2015/0152436 A1 | 6/2015 | Musunuru et al. |
| 2015/0166969 A1 | 6/2015 | Takeuchi et al. |
| 2015/0176013 A1 | 6/2015 | Musunuru et al. |
| 2015/0184139 A1 | 7/2015 | Zhang et al. |
| 2015/0203872 A1 | 7/2015 | Zhang |
| 2015/0218253 A1 | 8/2015 | Liu et al. |
| 2015/0232833 A1 | 8/2015 | Mali et al. |
| 2015/0232882 A1 | 8/2015 | Zhang et al. |
| 2015/0240261 A1 | 8/2015 | Siksnys et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0307867 A1 | 10/2015 | Orkin et al. |
| 2015/0322457 A1 | 11/2015 | Kim et al. |
| 2015/0344912 A1 | 12/2015 | Kim et al. |
| 2015/0353905 A1 | 12/2015 | Weiss et al. |
| 2015/0353917 A1 | 12/2015 | Miller |
| 2015/0356239 A1 | 12/2015 | Zhang et al. |
| 2016/0002670 A1 | 1/2016 | Church et al. |
| 2016/0010076 A1 | 1/2016 | Joung et al. |
| 2016/0010154 A1 | 1/2016 | Laganiere et al. |
| 2016/0017366 A1 | 1/2016 | Chen et al. |
| 2016/0024474 A1 | 1/2016 | Conway et al. |
| 2016/0024523 A1 | 1/2016 | Joung et al. |
| 2016/0024524 A1 | 1/2016 | Joung et al. |
| 2016/0030477 A1 | 2/2016 | Conway et al. |
| 2016/0032274 A1 | 2/2016 | Church et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0046963 A1 | 2/2016 | May et al. |
| 2016/0046978 A1 | 2/2016 | May et al. |
| 2016/0060653 A1 | 3/2016 | Doudna et al. |
| 2016/0060654 A1 | 3/2016 | Doudna et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0090607 A1 | 3/2016 | Conway et al. |
| 2016/0102324 A1 | 4/2016 | Duchateau et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0122774 A1 | 5/2016 | Duchateau et al. |
| 2016/0130608 A1 | 5/2016 | Doudna et al. |
| 2016/0130609 A1 | 5/2016 | Doudna et al. |
| 2016/0138008 A1 | 5/2016 | Doudna et al. |
| 2016/0138046 A1 | 5/2016 | Wu |
| 2016/0145646 A1 | 5/2016 | Frendewey et al. |
| 2016/0153003 A1 | 6/2016 | Joung et al. |
| 2016/0153004 A1 | 6/2016 | Zhang et al. |
| 2016/0153006 A1 | 6/2016 | Zhang et al. |
| 2016/0160210 A1 | 6/2016 | Mali et al. |
| 2016/0168592 A1 | 6/2016 | Church et al. |
| 2016/0175462 A1 | 6/2016 | Zhang et al. |
| 2016/0184362 A1 | 6/2016 | Duchateau et al. |
| 2016/0186152 A1 | 6/2016 | Brouns et al. |

(56) References Cited

U.S. PATENT DOCUMENTS

| | | |
|---|---|---|
| 2016/0186213 A1 | 6/2016 | Zhang et al. |
| 2016/0186214 A1 | 6/2016 | Brouns et al. |
| 2016/0201089 A1 | 7/2016 | Gersbach et al. |
| 2016/0208243 A1 | 7/2016 | Zhang et al. |
| 2016/0215276 A1 | 7/2016 | Liu et al. |
| 2016/0222416 A1 | 8/2016 | Church et al. |
| 2016/0237455 A1 | 8/2016 | Glucksmann et al. |
| 2016/0237456 A1 | 8/2016 | Church et al. |
| 2016/0251640 A1 | 9/2016 | May et al. |
| 2016/0272965 A1 | 9/2016 | Zhang et al. |
| 2016/0281072 A1 | 9/2016 | Zhang |
| 2016/0298097 A1 | 10/2016 | Chavez et al. |
| 2016/0298125 A1 | 10/2016 | Chen et al. |
| 2016/0298132 A1 | 10/2016 | Chen et al. |
| 2016/0298133 A1 | 10/2016 | Chen et al. |
| 2016/0298134 A1 | 10/2016 | Chen et al. |
| 2016/0298135 A1 | 10/2016 | Chen et al. |
| 2016/0298136 A1 | 10/2016 | Chen et al. |
| 2016/0298137 A1 | 10/2016 | Chen et al. |
| 2016/0298138 A1 | 10/2016 | Chen et al. |
| 2016/0304907 A1 | 10/2016 | Mali et al. |
| 2016/0312198 A1 | 10/2016 | Joung et al. |
| 2016/0312199 A1 | 10/2016 | Joung et al. |
| 2016/0312280 A1 | 10/2016 | May et al. |
| 2016/0319260 A1 | 11/2016 | Joung et al. |
| 2016/0319261 A1 | 11/2016 | Joung et al. |
| 2016/0319281 A1 | 11/2016 | Tsai et al. |
| 2016/0319349 A1 | 11/2016 | May et al. |
| 2016/0340662 A1 | 11/2016 | Zhang et al. |
| 2016/0355796 A1 | 12/2016 | Davidson et al. |
| 2016/0355797 A1 | 12/2016 | Konermann et al. |
| 2016/0355816 A1 | 12/2016 | Terns et al. |
| 2016/0369262 A1 | 12/2016 | Reik et al. |
| 2017/0037416 A1 | 2/2017 | Barrangou et al. |
| 2017/0044569 A9 | 2/2017 | Church et al. |
| 2017/0051276 A1 | 2/2017 | May et al. |
| 2017/0051310 A1 | 2/2017 | Doudna et al. |
| 2017/0051312 A1 | 2/2017 | Jinek et al. |
| 2017/0058271 A1 | 3/2017 | Joung et al. |
| 2017/0073705 A1 | 3/2017 | Chen et al. |
| 2017/0081650 A1 | 3/2017 | Joung et al. |
| 2017/0107536 A1 | 4/2017 | Zhang et al. |
| 2017/0107539 A1 | 4/2017 | Yu et al. |
| 2017/0137845 A1 | 5/2017 | Tan et al. |
| 2017/0152508 A1 | 6/2017 | Joung et al. |
| 2017/0152528 A1 | 6/2017 | Zhang |
| 2017/0166893 A1 | 6/2017 | Doudna et al. |
| 2017/0166903 A1 | 6/2017 | Zhang et al. |
| 2017/0175142 A1 | 6/2017 | Zhang et al. |
| 2017/0175143 A1 | 6/2017 | Tolar et al. |
| 2017/0175144 A1 | 6/2017 | Zhang et al. |
| 2017/0189450 A1 | 7/2017 | Conway et al. |
| 2017/0191078 A1 | 7/2017 | Zhang et al. |
| 2017/0191082 A1 | 7/2017 | Chen et al. |
| 2017/0198269 A1 | 7/2017 | Zhang et al. |
| 2017/0211142 A1 | 7/2017 | Smargon et al. |
| 2017/0215392 A1 | 8/2017 | Haining et al. |
| 2017/0233703 A1 | 8/2017 | Xie et al. |
| 2017/0268022 A1 | 9/2017 | Liu et al. |
| 2017/0298330 A1 | 10/2017 | Sato et al. |
| 2017/0306307 A1 | 10/2017 | Zhang et al. |
| 2017/0306335 A1 | 10/2017 | Zhang et al. |
| 2017/0314015 A1 | 11/2017 | Friedland et al. |
| 2017/0327805 A1 | 11/2017 | Joung et al. |
| 2017/0327806 A1 | 11/2017 | Joung et al. |
| 2017/0327820 A1 | 11/2017 | May et al. |
| 2017/0335300 A1 | 11/2017 | Frisch et al. |
| 2017/0349914 A1 | 12/2017 | Cox et al. |
| 2017/0349915 A1 | 12/2017 | May et al. |
| 2018/0002682 A1 | 1/2018 | Sternberg et al. |
| 2018/0021413 A1 | 1/2018 | Porteus |
| 2018/0021457 A1 | 1/2018 | Kim et al. |
| 2018/0030425 A1 | 2/2018 | Joung et al. |
| 2018/0030438 A1 | 2/2018 | Porteus et al. |
| 2018/0066242 A1 | 3/2018 | Zhang et al. |
| 2018/0071405 A1 | 3/2018 | Kim et al. |
| 2018/0073002 A1 | 3/2018 | Deiters et al. |
| 2018/0080051 A1 | 3/2018 | Sheikh et al. |
| 2018/0100148 A1 | 4/2018 | Vakulskas et al. |
| 2018/0119121 A1 | 5/2018 | Brouns et al. |
| 2018/0119175 A1 | 5/2018 | Conway et al. |
| 2018/0127780 A1 | 5/2018 | Liu et al. |
| 2018/0135073 A1 | 5/2018 | Chen et al. |
| 2018/0135109 A1 | 5/2018 | Jayaram et al. |
| 2018/0148735 A1 | 5/2018 | Begemann et al. |
| 2018/0155708 A1 | 6/2018 | Church et al. |
| 2018/0155716 A1 | 6/2018 | Zhang et al. |
| 2018/0163188 A1 | 6/2018 | Xie et al. |
| 2018/0163213 A1 | 6/2018 | Aneja et al. |
| 2018/0187176 A1 | 7/2018 | Behlke et al. |
| 2018/0187195 A1 | 7/2018 | Siksnys et al. |
| 2018/0200387 A1 | 7/2018 | Porteus |
| 2018/0208931 A1 | 7/2018 | Doudna et al. |
| 2018/0216088 A1 | 8/2018 | Joung et al. |
| 2018/0230495 A1 | 8/2018 | Doudna et al. |
| 2018/0230496 A1 | 8/2018 | Doudna et al. |
| 2018/0230497 A1 | 8/2018 | Doudna et al. |
| 2018/0237801 A1 | 8/2018 | Doudna et al. |
| 2018/0245100 A1 | 8/2018 | Doudna et al. |
| 2018/0245101 A1 | 8/2018 | Doudna et al. |
| 2018/0251791 A1 | 9/2018 | Doudna et al. |
| 2018/0251793 A1 | 9/2018 | Doudna et al. |
| 2018/0251794 A1 | 9/2018 | Doudna et al. |
| 2018/0251795 A1 | 9/2018 | Charpentier et al. |
| 2018/0265864 A1 | 9/2018 | Li et al. |
| 2018/0273609 A1 | 9/2018 | Porteus et al. |
| 2018/0273938 A1 | 9/2018 | Turk et al. |
| 2018/0273981 A1 | 9/2018 | Doudna et al. |
| 2018/0282713 A1 | 10/2018 | Van Der Oost |
| 2018/0282714 A1 | 10/2018 | Joung et al. |
| 2018/0282764 A1 | 10/2018 | Jinek et al. |
| 2018/0291383 A1 | 10/2018 | Musunuru et al. |
| 2018/0296603 A1 | 10/2018 | Gori et al. |
| 2018/0298360 A1 | 10/2018 | Sternberg et al. |
| 2018/0298406 A1 | 10/2018 | Doudna et al. |
| 2018/0298407 A1 | 10/2018 | Doudna et al. |
| 2018/0312824 A1 | 11/2018 | Zhang et al. |
| 2018/0312874 A1 | 11/2018 | Doudna et al. |
| 2018/0312875 A1 | 11/2018 | Doudna et al. |
| 2018/0312876 A1 | 11/2018 | Doudna et al. |
| 2018/0320163 A1 | 11/2018 | Koonin et al. |
| 2018/0320197 A1 | 11/2018 | Gersbach et al. |
| 2018/0320201 A1 | 11/2018 | Vakulskas et al. |
| 2018/0327761 A1 | 11/2018 | Duchateau et al. |

FOREIGN PATENT DOCUMENTS

| | | |
|---|---|---|
| WO | WO-2010/011961 A2 | 1/2010 |
| WO | WO-2013/098244 A1 | 7/2013 |
| WO | WO-2013/126794 A1 | 8/2013 |
| WO | WO-2013/141680 A1 | 9/2013 |
| WO | WO-2013/142578 A1 | 9/2013 |
| WO | WO-2013/176772 A1 | 11/2013 |
| WO | WO-2014/018423 A2 | 1/2014 |
| WO | WO-2014/065596 A1 | 5/2014 |
| WO | WO-2014/085593 A1 | 6/2014 |
| WO | WO-2014/089290 A1 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/099744 A1 | 6/2014 |
| WO | WO-2014/099750 A2 | 6/2014 |
| WO | WO-2014/113493 A1 | 7/2014 |
| WO | WO-2014/144288 A1 | 9/2014 |
| WO | WO-2014/144592 A2 | 9/2014 |
| WO | WO-2014/144761 A2 | 9/2014 |

(56) References Cited

FOREIGN PATENT DOCUMENTS

| | | |
|---|---|---|
| WO | WO-2014/145599 A2 | 9/2014 |
| WO | WO-2014/150624 A1 | 9/2014 |
| WO | WO-2014/152432 A2 | 9/2014 |
| WO | 2014/172458 A1 | 10/2014 |
| WO | WO-2014/165825 A2 | 10/2014 |
| WO | WO-2014/172458 A1 | 10/2014 |
| WO | WO-2014/186585 A2 | 11/2014 |
| WO | WO-2014/191518 A1 | 12/2014 |
| WO | WO-2014/191521 A2 | 12/2014 |
| WO | WO-2014/197568 A2 | 12/2014 |
| WO | WO-2014/197748 A2 | 12/2014 |
| WO | WO-2014/204578 A1 | 12/2014 |
| WO | WO-2014/204724 A1 | 12/2014 |
| WO | WO-2014/204725 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | 2015/006747 A2 | 1/2015 |
| WO | WO-2015/006290 A1 | 1/2015 |
| WO | WO-2015/006294 A2 | 1/2015 |
| WO | WO-2015/006498 A2 | 1/2015 |
| WO | WO-2015/010114 A1 | 1/2015 |
| WO | WO-2015/013583 A2 | 1/2015 |
| WO | WO-2015/021426 A1 | 2/2015 |
| WO | WO-2015/035162 A2 | 3/2015 |
| WO | 2015/048577 A2 | 4/2015 |
| WO | 2015/057976 A1 | 4/2015 |
| WO | WO-2015/048577 A2 | 4/2015 |
| WO | WO-2015/057976 A1 | 4/2015 |
| WO | WO-2015/077318 A1 | 5/2015 |
| WO | WO-2015/089351 A1 | 6/2015 |
| WO | WO-2015/089354 A1 | 6/2015 |
| WO | WO-2015/089427 A1 | 6/2015 |
| WO | WO-2015/089486 A2 | 6/2015 |
| WO | WO-2015/117081 A2 | 8/2015 |
| WO | 2015/148670 A1 | 10/2015 |
| WO | 2015/161276 A2 | 10/2015 |
| WO | WO-2015/148670 A1 | 10/2015 |
| WO | WO-2015/148716 A1 | 10/2015 |
| WO | WO-2015/148860 A1 | 10/2015 |
| WO | WO-2015/148863 A2 | 10/2015 |
| WO | WO-2015/161276 A2 | 10/2015 |
| WO | WO-2015/168547 A2 | 11/2015 |
| WO | WO-2015/179540 A1 | 11/2015 |
| WO | WO-2015/183885 A1 | 12/2015 |
| WO | WO-2015/188056 A1 | 12/2015 |
| WO | WO-2015/188065 A1 | 12/2015 |
| WO | 2016/014794 A1 | 1/2016 |
| WO | WO-2016-014794 A1 | 1/2016 |
| WO | WO-2016/019144 A2 | 2/2016 |
| WO | WO-2016/022363 A2 | 2/2016 |
| WO | WO-2016/028682 A1 | 2/2016 |
| WO | 2016/044416 A1 | 3/2016 |
| WO | WO-2016/044416 A1 | 3/2016 |
| WO | WO-2016/057821 A2 | 4/2016 |
| WO | WO-2016/057835 A2 | 4/2016 |
| WO | WO-2016/073433 A1 | 5/2016 |
| WO | WO-2016/081923 A2 | 5/2016 |
| WO | WO-2016/094880 A1 | 6/2016 |
| WO | WO-2016/106236 A1 | 6/2016 |
| WO | WO-2016/106244 A1 | 6/2016 |
| WO | WO-2016/111546 A2 | 7/2016 |
| WO | WO-2016/112242 A1 | 7/2016 |
| WO | WO-2016/114972 A1 | 7/2016 |
| WO | WO-2016/118726 A2 | 7/2016 |
| WO | WO-2016/123578 A1 | 8/2016 |
| WO | WO-2016/124765 A1 | 8/2016 |
| WO | WO-2016/135557 A2 | 9/2016 |
| WO | WO-2016/135558 A2 | 9/2016 |
| WO | WO-2016/135559 A2 | 9/2016 |
| WO | WO-2016/141224 A1 | 9/2016 |
| WO | WO-2016/161207 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO-2016/172727 A1 | 10/2016 |
| WO | WO-2016/182917 A1 | 11/2016 |
| WO | WO-2016/196655 A1 | 12/2016 |
| WO | WO-2016/201047 A1 | 12/2016 |
| WO | WO-2016/205613 A1 | 12/2016 |
| WO | WO-2016/205680 A1 | 12/2016 |
| WO | WO-2016/205703 A1 | 12/2016 |
| WO | WO-2016/205711 A1 | 12/2016 |
| WO | WO-2016/205749 A1 | 12/2016 |
| WO | WO-2016/205759 A1 | 12/2016 |
| WO | WO-2017/015015 A1 | 1/2017 |
| WO | WO-2017/040348 A1 | 3/2017 |
| WO | WO-2017/048969 A1 | 3/2017 |
| WO | WO-2017/064546 A1 | 4/2017 |
| WO | WO-2017/066588 A2 | 4/2017 |
| WO | WO-2017/066707 A1 | 4/2017 |
| WO | WO-2017/070633 A2 | 4/2017 |
| WO | WO-2017/077394 A2 | 5/2017 |
| WO | WO-2017/099494 A1 | 6/2017 |
| WO | WO-2017/106569 A1 | 6/2017 |
| WO | WO-2017/115268 A1 | 7/2017 |
| WO | WO-2017/127807 A1 | 7/2017 |
| WO | WO-2017/131150 A1 | 8/2017 |
| WO | WO-2017/134529 A1 | 8/2017 |
| WO | WO-2017/136335 A1 | 8/2017 |
| WO | WO-2017/141109 A1 | 8/2017 |
| WO | WO-2017/155407 A1 | 9/2017 |
| WO | WO-2017/155408 A1 | 9/2017 |
| WO | WO-2017/160890 A1 | 9/2017 |
| WO | WO-2017/161068 A1 | 9/2017 |
| WO | WO-2017/181107 A2 | 10/2017 |
| WO | WO-2017/182881 A2 | 10/2017 |
| WO | WO-2017/184768 A1 | 10/2017 |
| WO | WO-2017/189308 A1 | 11/2017 |
| WO | WO-2017/191503 A1 | 11/2017 |
| WO | WO-2017/197238 A1 | 11/2017 |
| WO | WO-2017/219027 A1 | 12/2017 |
| WO | WO-2017/219033 A1 | 12/2017 |
| WO | WO-2017/222773 A1 | 12/2017 |
| WO | WO-2018/022634 A1 | 2/2018 |
| WO | WO-2018/031686 A1 | 2/2018 |
| WO | WO-2018/035387 A1 | 2/2018 |
| WO | WO-2018/035388 A1 | 2/2018 |
| WO | WO-2018/049073 A1 | 3/2018 |
| WO | WO-2018/049077 A1 | 3/2018 |
| WO | WO-2018/049079 A1 | 3/2018 |
| WO | WO-2018/052247 A1 | 3/2018 |
| WO | WO-2018/053053 A1 | 3/2018 |
| WO | WO-2018/058064 A1 | 3/2018 |
| WO | WO-2018/062866 A2 | 4/2018 |
| WO | WO-2018/064352 A1 | 4/2018 |
| WO | WO-2018/064371 A1 | 4/2018 |
| WO | WO-2018/064387 A1 | 4/2018 |
| WO | WO-2018/068053 A2 | 4/2018 |
| WO | WO-2018/069474 A1 | 4/2018 |
| WO | WO-2018/071572 A1 | 4/2018 |
| WO | WO-2018/071868 A1 | 4/2018 |
| WO | WO-2018/071892 A1 | 4/2018 |
| WO | WO-2018/074979 A1 | 4/2018 |
| WO | WO-2018/089664 A1 | 5/2018 |
| WO | WO-2018/098383 A1 | 5/2018 |
| WO | WO-2018/108272 A1 | 6/2018 |
| WO | WO-2018/108338 A1 | 6/2018 |
| WO | WO-2018/108339 A1 | 6/2018 |
| WO | WO-2018/109101 A1 | 6/2018 |
| WO | WO-2018/111947 A1 | 6/2018 |
| WO | WO-2018/112451 A1 | 6/2018 |
| WO | WO-2018/142364 A1 | 8/2018 |
| WO | WO-2018/149888 A1 | 8/2018 |
| WO | WO-2018/170015 A1 | 9/2018 |
| WO | WO-2018/170184 A1 | 9/2018 |
| WO | WO-2018/172556 A1 | 9/2018 |
| WO | WO-2018/188571 A1 | 10/2018 |
| WO | WO-2018/191440 A1 | 10/2018 |
| WO | WO-2018/191715 A2 | 10/2018 |
| WO | WO-2018/192961 A1 | 10/2018 |
| WO | WO-2018/195540 A1 | 10/2018 |
| WO | WO-2018/195545 A2 | 10/2018 |
| WO | WO-2018/197495 A1 | 11/2018 |

(56) References Cited

FOREIGN PATENT DOCUMENTS

| WO | WO-2018/209712 A1 | 11/2018 |
| WO | WO-2018/213351 A1 | 11/2018 |
| WO | WO-2018/218135 A1 | 11/2018 |

OTHER PUBLICATIONS

Schaefer et al., Nat Methods, 14(6): 547-548, May 30, 2017.*
Hoggatt et al., Blood, 2009;113: 5444-5455.*
Rohrabaugh et al., Blood Cells Mol Dis. Apr. 15, 2011; 46(4): 318-320.*
Wang et al., Blood. 2014;124(6):913-923.*
Boitano et al., Aryl hydrocarbon receptor antagonists promote the expansion of human hematopoietic stem cells. Science. Sep. 10, 2010;329(5997):1345-8.
Mendelson et al., Hematopoietic stem cell niche maintenance during homeostasis and regeneration. Nat Med Aug. 2014;20(8):833-46.
Osborn et al., Fanconi anemia gene editing by the CRISPR/Cas9 system. Hum Gene Ther. Feb. 2015;26(2):114-26.
Pabst et al., Identification of small molecules that support human leukemia stem cell activity ex vivo. Nat Methods. Apr. 2014;11(4):436-42.
Zetsche et al., A split-Cas9 architecture for inducible genome editing and transcription modulation. Nat Biotechnol. Feb. 2015;33(2):139-42.
Zuris et al., Cationic lipid-mediated delivery of proteins enables efficient protein-based genome editing in vitro and in vivo. Nat Biotechnol. Jan. 2015;33(1):73-80.
International Search Report for Application No. PCT/US2016/031366, dated Jul. 7, 2016. 6 pages.
International Preliminary Report on Patentability for Application No. PCT/US2016/031366, dated Nov. 23, 2017. 10 pages.
Doyon et al., Transient cold shock enhances zinc-finger nuclease-mediated gene disruption. Nat Methods. 2010;7(6):459-460. Advance Online Publication.
Miller et al., A Tale nuclease architecture for efficient genome editing. Nat Biotechnol. 2011;29(2):143-148.
Kim et al., Highly efficient RNA-guided genome editing in human cells via delivery of purified Cas9 ribonucleoproteins. Genome Res. 2014;24(6):1012-1019.

* cited by examiner

*D10A Cas9 protein +/- HBB gRNA 8*

*D10A Cas9 protein +/- HBB gRNA 15*

Fig. 12A
Fig. 12B
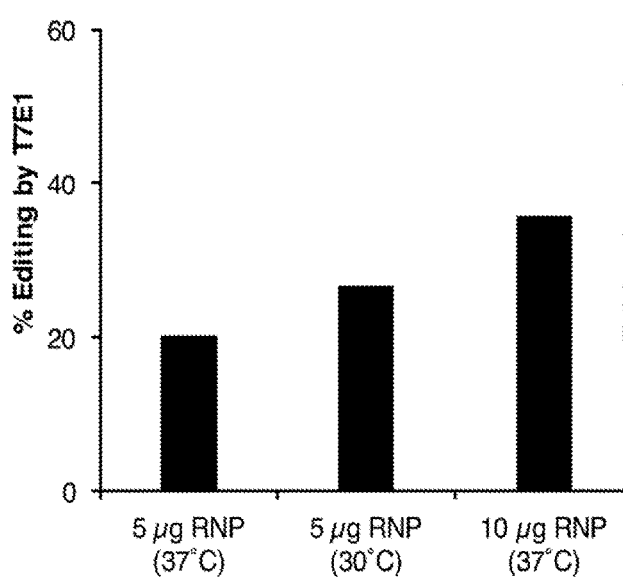
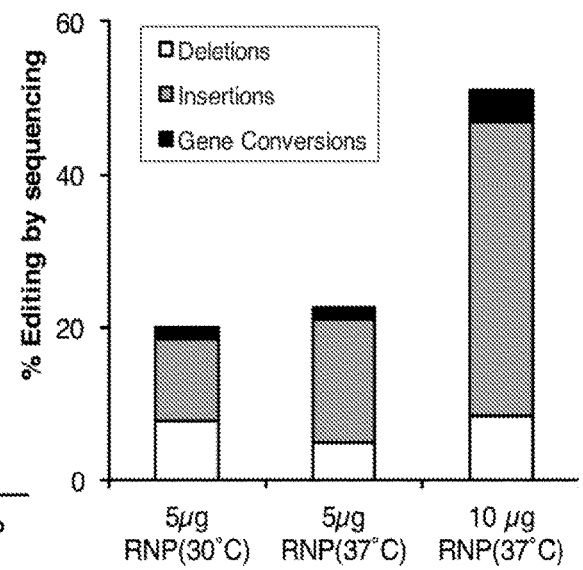
Fig. 12C
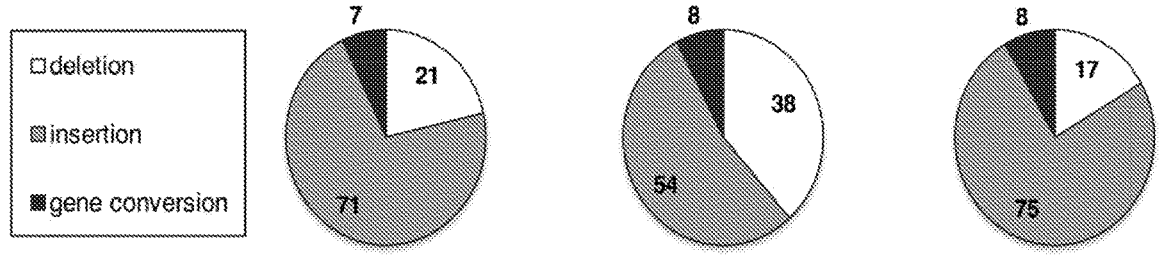

*Blood*

*Spleen*

*Bone marrow*

*Bone marrow*

*Spleen*

*RNP mPB CD34⁺ recipient*

*Control mPB CD34⁺ recipient*

OPTIMIZED CRISPR/CAS9 SYSTEMS AND METHODS FOR GENE EDITING IN STEM CELLS

RELATED APPLICATIONS

This application is a 35 U.S.C. § 371 national stage filing of International Application No. PCT/US2016/031366, filed on May 6, 2016, which in turn claims priority to U.S. Provisional Patent Application No. 62/159,785, filed on May 11, 2015; U.S. Provisional Patent Application No. 62/220,648, filed on Sep. 18, 2015; U.S. Provisional Patent Application No. 62/244,577, filed on Oct. 21, 2015; and U.S. Provisional Patent Application No. 62/279,020, filed on Jan. 15, 2016. The entire contents of each of the foregoing applications are expressly incorporated herein by reference.

SEQUENCE LISTING

The instant application contains a Sequence Listing which has been submitted electronically in ASCII format and is hereby incorporated by reference in its entirety. Said ASCII copy, created on May 6, 2016, is named 2016-05-06_126454-00520_ST25.txt and is 1.07 megabytes in size.

BACKGROUND

Gene therapy is a set of strategies used to modify the expression of an individual's genes or to correct abnormal genes. Cell therapy is the administration of live cells or maturation of a specific cell population in a patient for the treatment of a disease. Gene therapy and cell therapy are overlapping fields, with the goals of targeting the cause of diseases in the nucleic acid or cellular population. For example, hematopoietic diseases can be treated by transplantation of ex vivo gene-modified stem cells (e.g., hematopoietic stem/progenitor cells and hematopoietic stem cells, also referred to herein as HSCs) into a subject.

The discovery and application of the CRISPR/Cas9 system in mammalian cells results in effective and precise editing of target genes, e.g., through the non-homologous end joining pathway (NHEJ), homology directed repair (HDR), or other DNA repair pathways. Co-delivery of a Cas9 molecule and a target-specific guide RNA (gRNA) molecule, optionally along with a donor DNA repair template molecule, facilitates gene-editing of a target sequence (e.g., a disease-related mutation) in the genome. Thus, the use of the CRISPR/Cas9 system to modify genes in stem cells is a promising strategy for treating multiple genetic disorders. However, stem cells are extremely sensitive to manipulation in vitro and ex vivo and, thus, manipulation of stem cells using CRISPR/Cas9 systems, to date, has been inefficient and has resulted in little, if any, long-term viability and engraftment of the stem cells in vivo.

In order to facilitate the use of stem cells (e.g., HSCs), methods of expanding stem cells ex vivo have been developed. For example, some small molecules have been used to expand stem cells ex vivo, e.g., to increase proliferation, i.e., increase the number of stem cells by several fold in the culture, over a prolonged exposure period (typically an exposure period of more than one week). In those instances, a minimum exposure period of at least seven days is required in order to promote expansion of the stem cells, e.g., to lead to a significant increase in the number of stem cells in the culture ex vivo. However, this long period of ex vivo culturing required to expand the stem cell populations is not optimal for clinical applications.

Moreover, clinical efficacy of cell transplantation using the expanded stem cells is often contingent upon achieving a threshold level of engraftment which, to date, has been extremely difficult to achieve after manipulation of stem cells using CRISPR/Cas9 systems. See, for example, Walasek et al., *Ann. N.Y. Acad. Sci.* (2012), 1266:138-150. Indeed, there have been no published reports to date showing greater than 1% long term engraftment of HSCs manipulated with any CRISPR/Cas9 system, even after expansion. (Mandal et al. (2014) *Cell Stem Cell* 15(5):643-52). Thus, there remains a need for additional methods and compositions that can be used to optimize gene editing or regulation in stem cells (e.g., HSCs) to preserve the viability, multipotency, and self-renewal capability of stem cells.

SUMMARY

The methods and compositions described herein increase CRISPR/Cas-mediated gene editing in stem cells, e.g., HSCs. Exposing stem cells to foreign molecules, such as a CRISPR/Cas9 system component (e.g., a gRNA molecule, Cas9 molecule, or a template nucleic acid) stresses the stem cell and likely induces an innate immune response that triggers, for example, programmed cell death or stem cell differentiation. The use of the methods and systems described herein reduces or abrogates innate immune response signaling events that ultimately may lead to programmed cell death in stem cells after exposure to foreign CRISPR/Cas9 components. Specifically, by transiently (e.g., for a period of less than 120 hours) exposing stem cells to a stem cell viability enhancer prior to and/or after contacting stem cells with one or more CRISPR/Cas9 components, an innate immune response in the stem cell to the foreign CRISPR/Cas9 components is decreased, or prevented, thereby dramatically increasing the viability of the stem cell.

Additionally, the transient treatment of stem cells with stem cell viability enhancers (e.g., small molecules) that improve viability, prevent intracellular innate immune response, or both, before and/or after delivery of a CRISPR/Cas9 component also results in increased multipotency and self-renewal capability of the stem cell. Furthermore, the transient treatment of stem cells with stem cell viability enhancers (e.g., small molecules) that improve viability, prevent intracellular innate immune response, or both, before and/or after delivery of a CRISPR/Cas9 component also results in increased engraftment of the stem cell in a target tissue upon introduction of the modified stem cell into a subject. The unforeseen benefits of transiently exposing the stem cells to the reagents disclosed herein is surprising, given that they were typically used as stem cell expansion agents, e.g., to increase proliferation and the number of stem cells by several fold, and in view of the fact that the benefits for expansion of the stem cells required contact with the agents for a prolonged period of time (e.g., exposure for more than a week in culture). Thus, the methods and compositions described herein optimize the editing of a target nucleic acid sequence in a viable stem cell, and are particularly advantageous to advance the field of stem cell therapy in a multitude of clinical applications.

In one aspect, disclosed herein is a method of making a modified cell, e.g., stem cell, for transplantation, comprising (a) contacting a cell, e.g., stem cell, with a stem cell viability enhancer for a period of fewer than 120 hours, followed by (b) contacting the cell with a gRNA molecule and a Cas9 molecule in the absence of the stem cell viability enhancer.

In another aspect, disclosed herein is a method of modifying a target nucleic acid in a cell, e.g., stem cell, the method comprising contacting the cell with a stem cell viability enhancer; a modified gRNA molecule; and a Cas9 molecule. In one embodiment, the contacting step comprises (a) contacting the cell with the stem cell viability enhancer for a period of fewer than 120 hours, followed by (b) contacting the cell with the gRNA molecule and the Cas9 molecule in the absence of the stem cell viability enhancer.

In another aspect, disclosed herein is a method of transplanting a modified cell, e.g., stem cell, into a subject, the method comprising contacting a cell, e.g., stem cell, with a stem cell viability enhancer; a gRNA molecule; and a Cas9 molecule; thereby making a modified cell, e.g., modified stem cell, and transferring the modified cell, e.g., modified stem cell, to the subject. In one embodiment, the contacting step comprises (a) contacting the cell, e.g., stem cell, with the stem cell viability enhancer for a period of fewer than 120 hours, followed by (b) contacting the cell, e.g., stem cell, with the gRNA molecule and the Cas9 molecule in the absence of the stem cell viability enhancer.

In one embodiment, the step of contacting the cell, e.g., stem cell, with the gRNA molecule and the Cas9 molecule is performed using electroporation.

In one embodiment, the method further comprises cold-shocking the cell, e.g., stem cell, before electroporation. In one embodiment, the method further comprises cold-shocking the cell, e.g., stem cell, after electroporation. In one embodiment, the cell, e.g., stem cell, is cold-shocked at a temperature of about 30° C. to about 32° C.

In another embodiment, the period of fewer than 120 hours is about 96 hours. In one embodiment, the period of fewer than 120 hours is about 72 hours. In another embodiment, the period of fewer than 120 hours is about 48 hours. In another embodiment, the period of fewer than 120 hours is about 36 hours. In another embodiment, the period of fewer than 120 hours is about 24 hours. In another embodiment, the period of fewer than 120 hours is about 12 hours. In another embodiment, the period of fewer than 120 hours is about 115, 110, 105, 100, 95, 90, 85, 80, 75, 70, 65, 60, 55, 50, 45, 40, 35, 30, 25, 20, 15, 10, or 5 hours. In another embodiment, the period of fewer than 120 hours is about 24 to about 48 hours. In another embodiment, the period of fewer than 120 hours is about 1 to about 120 hours. In another embodiment, the period of fewer than 120 hours is about 48 to about 120 hours. In another embodiment, the period of fewer than 120 hours is about 24 to about 96 hours. In another embodiment, the period of fewer than 120 hours is about 24 to about 72 hours. In another embodiment, the period of fewer than 120 hours is about 36 to about 48 hours. In another embodiment, the period of fewer than 120 hours is about 24 to about 36 hours. In another embodiment, the period of fewer than 120 hours is about 12 to about 24 hours. In another embodiment, the period of fewer than 120 hours is about 12 to about 36 hours. In one embodiment, the period of fewer than 120 hours is a period not long enough to promote expansion of the stem cell.

In one embodiment, the method further comprises (c) contacting the cell, e.g., stem cell, with the stem cell viability enhancer for a period of fewer than 96 hours after step (b). In one embodiment, the method further comprises (c) contacting the cell, e.g., stem cell, with the stem cell viability enhancer for a period of fewer than 84 hours after step (b).

In one embodiment, the method further comprises (c) contacting the cell, e.g., stem cell, with the stem cell viability enhancer for a period of fewer than 72 hours after step (b). In one embodiment, the period of fewer than 72 hours after step (b) is a period not long enough to result in expansion of the cell.

In one embodiment, the cell is a population of cells, and the number of cells in the population of cells does not increase more than 10-fold during the period of fewer than 72 hours after step (b). In one embodiment, the cell is a population of cells, and the number of cells in the population of cells does not increase more than 5-fold during the period of fewer than 72 hours after step (b). In another embodiment, the cell is a population of cells, and the number of cells in the population of cells does not increase more than 4-fold during the period of fewer than 72 hours after step (b). In another embodiment, the cell is a population of cells, and the number of cells in the population of cells does not increase more than 3-fold during the period of fewer than 72 hours after step (b). In another embodiment, the cell is a population of cells, and the number of cells in the population of cells does not increase more than 2-fold during the period of fewer than 72 hours after step (b).

In one embodiment, the period of fewer than 72 hours after step (b) is a period of about 24 hours to about 48 hours after step (b). In one embodiment, the period of fewer than 72 hours after step (b) is a period of about 12 hours, 24 hours, 36 hours, 48 hours, or 60 hours after step (b).

In one embodiment, the cell, e.g., stem cell, is transferred into a human subject within 96 hours of the end of the contacting step or steps. In one embodiment, the stem cell is transferred into a human subject within 72 hours of the end of the contacting step or steps. In one embodiment, the stem cell is transferred into a human subject within 60 hours of the end of the contacting step or steps. In one embodiment, the stem cell is transferred into a human subject within 48 hours of the end of the contacting step or steps. In one embodiment, the stem cell is transferred into a human subject within 36 hours of the end of the contacting step or steps. In one embodiment, the stem cell is transferred into a human subject within 24 hours of the end of the contacting step or steps.

In one embodiment, the cell, e.g., stem cell, is cryopreserved within 96 hours of the end of the contacting step or steps. In one embodiment, the stem cell is cryopreserved within 72 hours of the end of the contacting step or steps. In one embodiment, the stem cell is cryopreserved within 60 hours of the end of the contacting step or steps. In one embodiment, the stem cell is cryopreserved within 48 hours of the end of the contacting step or steps. In one embodiment, the stem cell is cryopreserved within 36 hours of the end of the contacting step or steps. In one embodiment, the stem cell is cryopreserved within 24 hours of the end of the contacting step or steps.

In one embodiment, the stem cell viability enhancer inhibits differentiation of the stem cell. In another embodiment, the stem cell viability enhancer inhibits programmed cell death of the stem cell. In another embodiment, the stem cell viability enhancer inhibits senescence of the stem cell. In another embodiment, the stem cell viability enhancer inhibits an innate immune response of the stem cell. In one embodiment, the stem cell viability enhancer inhibits programmed cell death by inhibiting autophagy or apoptosis of the stem cell.

In one embodiment, the stem cell engrafts into a target tissue of the subject.

In one embodiment, the stem cell comprises a population of stem cells, and wherein at least 2% of the stem cells engraft into the target tissue of the subject. In one embodiment, the stem cell comprises a population of stem cells, and wherein at least 3% of the stem cells engraft into the target tissue of the subject. In one embodiment, the stem cell comprises a population of stem cells, and wherein at least 4% of the stem cells engraft into the target tissue of the subject. In one embodiment, the stem cell comprises a population of stem cells, and wherein at least 5% of the stem cells engraft into the target tissue of the subject. In one embodiment, the stem cell comprises a population of stem cells, and wherein at least 6%, 7%, 8%, 9%, or 10% of the stem cells engraft into the target tissue of the subject. In one embodiment, the stem cell comprises a population of stem cells, and wherein at least 15% of the stem cells engraft into the target tissue of the subject. In one embodiment, the stem cell comprises a population of stem cells, and wherein at least 20% of the stem cells engraft into the target tissue of the subject. In one embodiment, the stem cell comprises a population of stem cells, and wherein at least 25% of the stem cells engraft into the target tissue of the subject. In one embodiment, the stem cell comprises a population of stem cells, and wherein at least 30%, 35%, 40%, 45%, or 50% of the stem cells engraft into the target tissue of the subject.

In one embodiment, the cell comprises a population of cells, and wherein at least 1% of the cells are capable of engrafting into bone marrow of the subject. In another embodiment, at least 5% of the cells are capable of engrafting into bone marrow of the subject. In another embodiment, at least 10% of the cells are capable of engrafting into bone marrow of the subject. In another embodiment, at least 15%, 20%, 25%, 30%, 35%, 40%, 45%, or 50% of the cells are capable of engrafting into bone marrow of the subject.

In one embodiment, the cell comprises a population of cells, and at least 1% of the cells reconstitute the peripheral blood of the subject. In another embodiment, at least 2.5% of the cells reconstitute the peripheral blood of the subject. In another embodiment, at least 5% of the cells reconstitute the peripheral blood of the subject. In another embodiment, at least 10% of the cells reconstitute the peripheral blood of the subject. In another embodiment, at least 20% of the cells reconstitute the peripheral blood of the subject. In another embodiment, at least 25% of the cells reconstitute the peripheral blood of the subject. In another embodiment, at least 30% of the cells reconstitute the peripheral blood of the subject. In another embodiment, at least 35% of the cells reconstitute the peripheral blood of the subject. In another embodiment, at least 40% of the cells reconstitute the peripheral blood of the subject. In another embodiment, at least 45% of the cells reconstitute the peripheral blood of the subject. In another embodiment, at least 50% of the cells reconstitute the peripheral blood of the subject. In another embodiment, at least 55% of the cells reconstitute the peripheral blood of the subject. In another embodiment, at least 60% of the cells reconstitute the peripheral blood of the subject. In another embodiment, at least 65% of the cells reconstitute the peripheral blood of the subject. In another embodiment, at least 70% of the cells reconstitute the peripheral blood of the subject. In another embodiment, at least 75% of the cells reconstitute the peripheral blood of the subject. In another embodiment, at least 80% of the cells reconstitute the peripheral blood of the subject. In another embodiment, at least 85% of the cells reconstitute the peripheral blood of the subject. In another embodiment, at least 80% of the cells reconstitute the peripheral blood of the subject. In another embodiment, at least 85% of the cells reconstitute the peripheral blood of the subject. In another embodiment, at least 90% of the cells reconstitute the peripheral blood of the subject. In another embodiment, at least 95% of the cells reconstitute the peripheral blood of the subject. In another embodiment, at least 100% of the cells reconstitute the peripheral blood of the subject. In one embodiment, the stem cell remains engrafted in the target tissue of the subject for at least 16 weeks. In another embodiment, the stem cell remains engrafted in the target tissue of the subject for at least 20 weeks. In another embodiment, the stem cell remains engrafted in the target tissue of the subject for at least 24 weeks. In another embodiment, the stem cell remains engrafted in the target tissue of the subject for at least 6 months. In another embodiment, the stem cell remains engrafted in the target tissue of the subject for at least 9 months. In another embodiment, the stem cell remains engrafted in the target tissue of the subject for at least 1 year. In another embodiment, the cell is capable of engrafting into the target tissue of the subject for the remainder of the life of the subject.

In one embodiment, the target tissue is peripheral blood, bone marrow, or spleen. In one embodiment, the cell is a stem cell. In one embodiment, the stem cell is a hematopoietic stem/progenitor cell (HSC). As used herein, the term HSC refers to both hematopoietic stem cells and hematopoietic stem progenitor cells. In one embodiment, the stem cell is selected from the group consisting of a circulating blood cell, a mobilized blood cell, a bone marrow cell, a myeloid progenitor cell, a lymphoid progenitor cell, a multipotent progenitor cell, a lineage restricted progenitor cell, an endothelial cell, or a mesenchymal stromal cell. In another embodiment, the HSC is from a non-cord blood source, an umbilical cord source, or a cord blood source. In one embodiment, the HSC is a CD34+ cell.

In one embodiment, the method further comprises isolating the cell, e.g., stem cell, from the subject before the contacting step or steps.

In one embodiment, the method further comprises culturing the cell, e.g., stem cell, in a medium comprising one or more cytokines after step (b). In one embodiment, the medium comprises the one or more cytokines and the stem cell viability enhancer. In one embodiment, the one or more cytokines is selected from the group consisting of stem cell factor (SCF), thrombopoietin (TPO), Flt-3 ligand (FL), interleukin-6 (IL-6), and interleukin-11 (IL-11).

In one embodiment, the method further comprises culturing the cell, e.g., stem cell, in a medium after step (b), wherein the medium comprises one or more of a basic fibroblast growth factor (bFGF), a vascular endothelial growth factor (VEGF), a Notch signaling modulator, a TGF-β signaling modulator, insulin-like growth factor-binding protein 1 (IGFBP1), insulin-like growth factor binding protein 2 (IGFBP2), insulin-like growth factor 1, insulin-like growth factor 2 (IGF2), insulin-like growth factor 3 (IGF3), an angiopoietin (ANG1), an angiopoietin-like protein (ANGPTL4), a SDF1/CXCR4 axis modulator, a Wnt signaling modulator, or combinations thereof.

In one embodiment, the cell, e.g., stem cell, is cultured in the medium for at least 1, 2, 3, 4, 5, 6, or 7 days.

In one embodiment, the stem cell viability enhancer is an aryl hydrocarbon receptor (AhR) antagonist or an innate immune response antagonist. In one embodiment, the AhR antagonist is selected from the group consisting of StemRegenin-1 (SR1), LGC0006, alpha-napthoflavone, and CH-223191. In one embodiment, the AhR antagonist is SR1. In one embodiment, the innate immune response antagonist is selected from the group consisting of cyclosporin A, dexamethasone, reservatrol, a MyD88 inhibitory peptide, an RNAi agent targeting Myd88, a B18R recombinant protein, a glucocorticoid, OxPAPC, a TLR antagonist, rapamycin, BX795, and a RLR shRNA. In one embodiment, the stem cell viability enhancer is selected from the group consisting of MG132, SB431542, UM171, UM729, and 16, 16-dimethyl prostaglandin E2 (dmPGE2).

In one embodiment, the Cas9 molecule is an enzymatically active Cas9 (eaCas9). In one embodiment, the Cas9 molecule is selected from the group consisting of wild-type Cas9, a nickase Cas9, a dead Cas9 (dCas9), a split Cas9, and an inducible Cas9. In one embodiment, the Cas9 molecule comprises N-terminal RuvC-like domain cleavage activity, but has no HNH-like domain cleavage activity. In one embodiment, the Cas9 molecule comprises an amino acid mutation at an amino acid position corresponding to amino acid position N863 of *Streptococcus pyogenes* Cas9. In one embodiment, the Cas9 molecule comprises HNH-like domain cleavage activity but has no N-terminal RuvC-like domain cleavage activity. In one embodiment, the Cas9 molecule comprises an amino acid mutation at an amino acid position corresponding to amino acid position D10 of *Streptococcus pyogenes* Cas9.

In one embodiment, the Cas9 molecule is a Cas9 polypeptide. In one embodiment, the gRNA molecule and the Cas9 polypeptide are associated in a pre-formed ribonucleotide complex. In one embodiment, the Cas9 molecule is a nucleic acid encoding a Cas9 polypeptide.

In one embodiment, the gRNA molecule comprises a 5'-end cap structure. In one embodiment, the gRNA molecule comprises a 3'-end poly-A tail.

In one embodiment, the method further comprises contacting the cell with a template nucleic acid. In one embodiment, the cell is contacted with the template nucleic acid during the same contacting step as the gRNA molecule and the Cas9 molecule. In one embodiment, the template nucleic acid is a single stranded oligodeoxynucleotide (ssODN). In one embodiment, the ssODN comprises a 5' phosphorothionate modification, a 3' phosphorothionate modification, or a combination thereof.

In one embodiment, the method further comprises contacting the stem cell with a transgene, wherein the contacting occurs under conditions that allow the transgene to integrate into the genome of the stem cell. In one embodiment, the transgene is a gene is a chemotherapy selection marker, a cell surface antigen, or a suicide gene.

In one embodiment, the transgene integrates into a safe harbor locus. In one embodiment, the safe harbor locus is the AAVS1 safe harbor locus.

In one embodiment, the transgene is a chemotherapy selection marker, a cell surface antigen, or a suicide gene. In one embodiment, the chemotherapy selection marker is a gene encoding the P140K variant of methylguanine methyltransferase (P140K). In another embodiment, the cell surface antigen is a gene encoding a truncated CD19 (tCD19) or a gene encoding a truncated CD20 (tCD20). In another embodiment, the suicide gene is a gene encoding tCD20 or an inducible Caspase-9 transgene (iCaspase-9).

In one embodiment, the transgene is a gene encoding P140K, a gene encoding tCD19, a gene encoding tCD20, or a gene encoding iCaspase-9.

In another embodiment, the cell is contacted with a plurality of transgenes. In one embodiment, the plurality of transgenes are integrated into the genome of the cell. In another embodiment, the plurality of transgenes are integrated into a safe harbor locus in the genome of the cell. In one embodiment, the safe harbor locus is the AAVS1 safe harbor locus.

In one embodiment, the plurality of transgenes comprise two, three, or all of: a gene encoding the P140K variant of methylguanine methyltransferase, a gene encoding tCD19, a gene encoding tCD20, or an iCaspase-9. In another embodiment, the plurality of transgenes comprise or consist of a gene encoding the P140K variant of methylguanine methyltransferase and a gene encoding tCD20.

In one embodiment, the method further comprises contacting the cell with an enzymatically inactive (eiCas9) molecule. In one embodiment, the eiCas9 is fused to a transcriptional repressor or a transcriptional activator.

In one embodiment, the gRNA molecule comprises a targeting domain which is complementary to a target domain in a target gene. In one embodiment, the target gene is described in Table 4.

In one aspect, disclosed herein is a cell altered by any method disclosed herein.

In another aspect, disclosed herein is a pharmaceutical composition comprising a cell disclosed herein.

In one aspect, disclosed herein is a method of treating or preventing a disease in a subject comprising administering to the subject a modified cell or a cell altered by a method disclosed herein.

In one aspect, disclosed herein is a stem cell gene editing system comprising a stem cell viability enhancer; a gRNA molecule, and a Cas9 molecule. The gRNA molecule may be a modified gRNA molecule. In one embodiment, the stem cell gene editing system further comprises a stem cell, wherein the stem cell comprises the gRNA molecule and the Cas9 molecule. In one embodiment, the stem cell gene editing system further comprises a stem cell, wherein the stem cell comprises the stem cell viability enhancer.

In one embodiment, the stem cell gene editing system is a kit comprising each of the components. In another embodiment, the stem cell gene editing system is a composition. In one embodiment, the composition is part of a kit. In one embodiment, the kit further comprises instructions for modifying a target nucleic acid in a stem cell.

In one embodiment, the stem cell viability enhancer is selected from the group consisting of an aryl hydrocarbon receptor (AhR) antagonist or an innate immune response antagonist. In one embodiment, the AhR antagonist is selected from the group consisting of StemRegenin-1 (SR1), AhRA, dimethoxyflavone, 6,2',4'-trimethoxyflavone, LGC0006, alpha-napthoflavone, and CH-223191. In one embodiment, the AhR antagonist is SR1. In one embodiment, the innate immune response antagonist is selected from the group consisting of cyclosporin A, dexamethasone, resveratrol, a MyD88 inhibitory peptide, an RNAi agent targeting Myd88, a B18R recombinant protein, a glucocorticoid, OxPAPC, a TLR antagonist, rapamycin, BX795, and a RLR inhibitor. In one embodiment, the stem cell viability enhancer is selected from the group consisting of MG132, SB431542, UM171, UM729, and 16, 16-dimethyl prostaglandin E2 (dmPGE2).

In one embodiment, the modified gRNA molecule comprises a 5'-end cap structure. In one embodiment, the modified gRNA molecule comprises a 3'-end poly-adenine tail. In one embodiment, the modified gRNA molecule comprises a 5' end cap structure and a 3'-end poly-adenine tail.

In one embodiment, the Cas9 molecule is selected from the group consisting of wild-type Cas9, a nickase Cas9, a dead Cas9 (dCas9), a split Cas9, and an inducible Cas9. In one embodiment, the Cas9 molecule is an enzymatically active Cas9 (eaCas9).

In one embodiment, the Cas9 molecule comprises N-terminal RuvC-like domain cleavage activity, but has no HNH-like domain cleavage activity. In one embodiment, the Cas9 molecule comprises an amino acid mutation at an amino acid position corresponding to amino acid position N863 of

*Streptococcus pyogenes* Cas9. In one embodiment, the Cas9 molecule comprises HNH-like domain cleavage activity but has no N-terminal RuvC-like domain cleavage activity. In one embodiment, the Cas9 molecule comprises an amino acid mutation at an amino acid position corresponding to amino acid position D10 of *Streptococcus pyogenes* Cas9.

In one embodiment, the Cas9 molecule is a Cas9 polypeptide. In one embodiment, the modified gRNA molecule and the Cas9 polypeptide are associated in a pre-formed ribonucleotide complex. In one embodiment, the Cas9 molecule is a nucleic acid encoding a Cas9 polypeptide.

In one embodiment, the stem cell gene editing system further comprises a cytokine. In one embodiment, the cytokine is selected from the group consisting of stem cell factor (SCF), thrombopoietin (TPO), Flt-3 ligand (FL), interleukin-6 (IL-6), and interleukin-11 (IL-11).

In one embodiment, the composition further comprises one or more of: a basic fibroblast growth factor (bFGF), a vascular endothelial growth factor (VEGF), a Notch signaling modulator, a TGF-β signaling modulator, insulin-like growth factor-binding protein 1 (IGFBP1), insulin-like growth factor binding protein 2 (IGFBP2), insulin-like growth factor 1, insulin-like growth factor 2 (IGF2), insulin-like growth factor 3 (IGF3), an angiopoietin (ANG1), an angiopoietin-like protein (ANGPTL4), a SDF1/CXCR4 axis modulator, or a Wnt signaling modulator.

In one embodiment, the stem cell gene editing system further comprises a template nucleic acid. In one embodiment, the template nucleic acid is a single stranded oligodeoxynucleotide (ssODN). In one embodiment, the ssODN comprises a 5' phosphorothioate modification, a 3' phosphorothioate modification, or both a 5' phosphorothioate modification and a 3' phosphorothioate modification.

In one embodiment, the gRNA molecule comprises a targeting domain which is complementary to a target domain in a target gene. In one embodiment, the target gene is described in Table 4.

In one aspect, disclosed herein is a cell comprising a composition disclosed herein.

In another aspect, disclosed herein is a pharmaceutical composition comprising a composition disclosed herein, and a pharmaceutically acceptable carrier. In another aspect, disclosed herein is a pharmaceutical composition comprising a cell disclosed herein, and a pharmaceutically acceptable carrier.

In one embodiment, the HSC cell differentiates in vivo after transplantation. In one embodiment, the HSC cell differentiates into B cells, T cells, erythroid cells, and/or myeloid cells. In one embodiment, the HSC cell reconstitutes hematopoiesis in the subject.

In one embodiment, the cell is transplanted into the subject via intravenous infusion.

In one embodiment, the contacting step or steps occur ex vivo.

In one embodiment, the method further comprises generating the cell from an iPS cell or from an endothelial cell.

In one embodiment, the one or more cell viability enhancers has one or more of the following properties: enhances cell maintenance, enhances cell survival, enhances cell viability, or enhances cell proliferation. In another embodiment, the one or more cell viability enhancers has one or more of the following properties: inhibits differentiation, inhibits cell death via apoptosis, inhibits necrosis, inhibits autophagy, or inhibits senescence. In one embodiment, the one or more cell viability enhancers inhibits senescence associated with DNA damage response.

In one embodiment, the one or more cell viability enhancers inhibits an innate immune response and/or prevents apoptosis of the cell. In another embodiment, the one or more cell viability enhancers inhibits an innate immune response and/or prevents apoptosis of the cell in response to a CRISPR/Cas9 component. In another embodiment, the one or more cell viability enhancers inhibits the interferon or toll-like receptor response to foreign nucleic acids.

In one embodiment, the method further comprises contacting the cell with a chemotherapeutic agent to increase the number of cells. In one embodiment, the cell comprises a chemotherapy selection marker. In one embodiment, the chemotherapy selection marker is the P140K variant of methylguanine methyltransferase. In one embodiment, the chemotherapeutic agent is O6BG/BCNU. In one embodiment, the contacting occurs ex vivo or in vivo.

In one embodiment, the method further comprises contacting the cell with a cell surface antigen binding agent for selection of the cell. In one embodiment, the cell comprises a cell surface antigen. In another embodiment, the cell surface antigen is tCD19 or tCD20. In one embodiment, the cell surface antigen binding agent is a tCD19- or tCD20-binding reagent. In one embodiment, the contacting occurs ex vivo or in vivo.

In one embodiment, the method further comprises contacting the cell with an agent that results in cell death. In one embodiment, the cell is an HSC comprising a suicide gene.

In one embodiment, the method further comprises contacting the cell with an anti-CD20 antibody. In one embodiment, the anti-CD20 antibody is Rituximab.

In one embodiment, the method further comprises contacting the cell with an agent that dimerizes iCaspase-9 wherein the cell comprises iCaspase-9. In one embodiment, the agent that dimerizes iCaspase-9 is a cell permeable dimerizer. In another embodiment, the cell permeable dimerizer is AP20187 or AP1903.

In one embodiment, the method further comprises contacting the cell with a template nucleic acid comprising the transgene, and one or more gRNAs comprising a targeting domain which is complementary with a target domain from a region into which the transgene is integrated.

In one embodiment, the method further comprises culturing the cell under conditions that allow expression of the transgene.

In another embodiment, the eiCas9 molecule is a fusion molecule that regulates a target gene. In one embodiment, the target gene is a target gene that transiently prevents cell death, enhances cell survival, enhances cell viability, or enhances proliferation. In another embodiment, the eiCas9 molecule is fused to a KRAB domain.

In one embodiment, expression of the transgene does not significantly reduce multipotency, cellular fitness, or both. In another embodiment, expression of the transgene does not significantly reduce viability, multipotency, cellular fitness, or both, upon acute exposure to a CRISPR/Cas9 component.

In one embodiment, the cell is cultured under hypoxic culture conditions. In one embodiment, hypoxic culture conditions comprise 10% or less, 8% or less, 5% or less, 3% or less, 1% or less, or 0.5% or less $O_2$.

In one embodiment, the cell is cultured in a three dimensional culture system. In one embedment, the three dimensional culture system is a NANEX™ 3D culture system.

In one embodiment, the method further comprises co-culturing the cell with an endothelial cell, a mesenchymal cell, or both. In one embodiment, the endothelial cell is a VeraVecs cell. In another embodiment, the mesenchymal cell is a mesenchymal stromal cell, or a perivascular mesenchymal cell.

In one embodiment, the method further comprises purifying the cell after the contacting step. In one embodiment, the method further comprises washing the cell between the contacting step with the cell viability enhancer and the contacting step with the gRNA molecule and the Cas9 molecule.

In one embodiment, the subject is the same subject from whom the cell is isolated. In another embodiment, the subject is a different subject from whom the cell is isolated.

In another aspect, disclosed herein is a method of treating or preventing a disease in a subject comprising administering to the subject a modified cell or a cell altered by the method disclosed herein. In one embodiment, the subject is suffering from a disease, or is at risk of developing, a disease listed in Table 4. In another embodiment, the disease is a hemoglobinopathy, an anemia, a disorder of hemostasis, a metabolic disorder, a severe immunodeficiency, a myeloid immunodeficiency, a B-lymphoid and immunoglobulin immunodeficiency, a cytopenia disorder, a metabolic, enzyme deficiency, trafficking, and storage disease, an erythroid disease, an autoimmune disease an inflammatory disease, an infectious disease, or an oncologic disease. In one embodiment, the cytopenia disorder has neurological complications. In another embodiment, the oncologic disease is a lymphoma or a leukemia.

In one embodiment, between about $1\times10^5$ and about $1\times10^8$ altered or modified cells per kg bodyweight are administered to the subject. In another embodiment, between about $1\times10^6$ and about $1\times10^7$ altered or modified cells per kg bodyweight are administered to the subject. In another embodiment, between about $1\times10^6$, about $2\times10^6$, or about $5\times10^6$ altered or modified cells per kg bodyweight are administered to the subject.

In one embodiment, the cell is for use in the manufacture of a medicament for treating or preventing disease. In one embodiment, the disease is a disease listed in Table 4.

In one embodiment, the cell is a hematopoietic stem/progenitor cell (HSC). In one embodiment, the HSC cell is capable of differentiating in vivo after transplantation into the subject. In one embodiment, the HSC cell is capable of differentiating into B cells, T cells, erythroid cells, and/or myeloid cells. In another embodiment, the HSC cell is capable of reconstituting hematopoiesis in the subject.

In another aspect, disclosed herein is a reaction mixture comprising: (a) a cell; (b) one or more CRISPR/Cas9 components; and (c) one, two, or all of the following: (i) a cell viability enhancer; (ii) a transgene; or (iii) an eiCas9 molecule.

In one embodiment, the one or more CRISPR/Cas9 components comprise a Cas9 molecule, a gRNA molecule, or both. In another embodiment, the reaction mixture further comprises a donor template nucleic acid. In another embodiment, the eiCas9 molecule is fused to a transcriptional repressor or transcriptional activator.

In another aspect, disclosed herein is a kit comprising: (a) one, two, or all of the following: (i) a cell viability enhancer; (ii) a transgene; or (iii) an eiCas9 molecule, and (b) instructions for altering a cell or making a modified cell.

In one embodiment, the eiCas9 molecule is fused to a transcriptional repressor or transcriptional activator. In another embodiment, the cell is an HSC.

In another aspect, disclosed herein is the use of a cell in the manufacture of a medicament for treating or preventing a disease. In one embodiment, the disease is a disease listed in Table 4.

In one aspect, disclosed herein is the use of a cell described herein in the manufacture of a medicament for treating or preventing a disease, e.g., a disease described herein, e.g., a disease listed in Table 4.

In another aspect, disclosed herein is a cell described herein for treating or preventing a disease, e.g., a disease described herein, e.g., a disease listed in Table 4.

The compositions, reaction mixtures and kits, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which the present disclosure belongs. Although methods and materials similar or equivalent to those described herein can be used in the practice or testing of embodiments of the present disclosure, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of embodiments of the present disclosure will be apparent from the detailed description, drawings, and from the claims.

BRIEF DESCRIPTION OF THE DRAWINGS

FIG. 7A depicts Differential Scanning Fluorimetry Shift Assay after complexing D10A protein with the indicated HBB gRNAs added at 1:1 molar ratio gRNA:RNP. FIG. 7B depicts detection of Cas9 protein in cell lysates 72 hours after human adult CD34+ HSCs were electroporated with D10A nickase RNP or D10A mRNA with gRNAs HBB-8 (SEQ ID NO:388) and HBB-15 (SEQ ID NO:387). The electroporation program (P2 or P3) used is indicated at the top of the image. 2×gRNA: 10 µg each gRNA was co-delivered with D10A mRNA (vs. 5 µg of each gRNA).

FIG. 8A shows that gene edited adult CD34+ cells maintain expression of stem cell markers CD34 and CD133 at 72 hours after electroporation. FIG. 8B depicts absolute live (7-AAD⁻ AnnexinV⁻) CD34+ cell number at indicated time points relative to electroporation of D10A RNP HBB gRNA pair. FIG. 8C shows that gene edited adult CD34+ cells maintain hematopoietic colony forming cell (CFC) activity and multipotency. E: erythroid, G: granulocyte, M: macrophage, GM: granulocyte-macrophage, GEMM: granulocyte-erythrocyte-macrophage-monocyte CFCs.

FIG. 9A depicts percentage of gene editing events as detected by T7E1 endonuclease assay analysis of the HBB locus in human adult CD34+ HSCs. FIG. 9B depicts DNA sequence analysis of the HBB locus from human adult CD34+ HSCs. The subtypes of gene editing events (insertions, deletions, indels, and gene conversion events) are indicated. RNP* refers to use of alternate electroporation program (P3). FIG. 9C depicts percentages of types of editing events detected in the gDNA from the human adult CD34+ HSCs electroporated with the conditions shown in FIG. 9B. Data are shown as a percentage of all gene editing events.

FIG. 11A shows that gene edited human CB CD34+ HSC cells maintain viability after electroporation. Right: Absolute live (7-AAD⁻AnnexinV⁻) human CB CD34+ HSC cell number at indicated time points relative to electroporation of D10A RNP HBB gRNA pair. FIG. 11B depicts that gene edited CB CD34+ cells maintained hematopoietic colony forming cell (CFC) activity and multipotency. E: erythroid, G: granulocyte, M: macrophage, GM: granulocyte-macrophage, GEMM: granulocyte-erythrocyte-macrophage-monocyte CFCs. The amounts of D10A RNP delivered per million cells (5 or 10 µg) and the 2-hour recovery temperature (parentheses) after electroporation of the parental CB CD34+ cells are indicated.

FIGS. 12A, 12B, and 12C show that D10A nickase RNP co-delivered with HBB targeted gRNA pair supported gene editing and HDR in human CB CD34+ HSCs. FIG. 12A depicts Percentage of gene editing events as detected by T7E1 endonuclease assay analysis of the HBB locus in gene-edited human CB CD34+ HSCs. FIG. 12B depicts DNA sequence analysis of the HBB locus in gene-edited human CB CD34+ HSCs. The subtypes of gene editing events (insertions, deletions, indels, and gene conversion events) are indicated as a fraction of the total sequencing reads. FIG. 12C depicts subtypes of gene editing events expressed as relative percentage to the total number gene editing events detected. The amounts of D10A RNP delivered per million cells (5 or 10 µg) and the 2-hour recovery temperature (parentheses) after electroporation of the parental CB CD34+ HSCs are indicated.

FIG. 13A depicts CD71 (transferrin receptor and CD235 (Glycophorin A). FIG. 13B depicts fetal hemoglobin (g-hemoglobin). FIG.

13C depicts loss of CD45 and dsDNA through enucleation as indicated by the absence of dsDNA (negative for dsDNA binding dye DRAQ5). Note that, unlike adult CD34+ cells, CB CD34+ cells differentiate into fetal-like erythroblasts that express fetal g-hemoglobin (not adult b-hemoglobin).

Figure 14A:
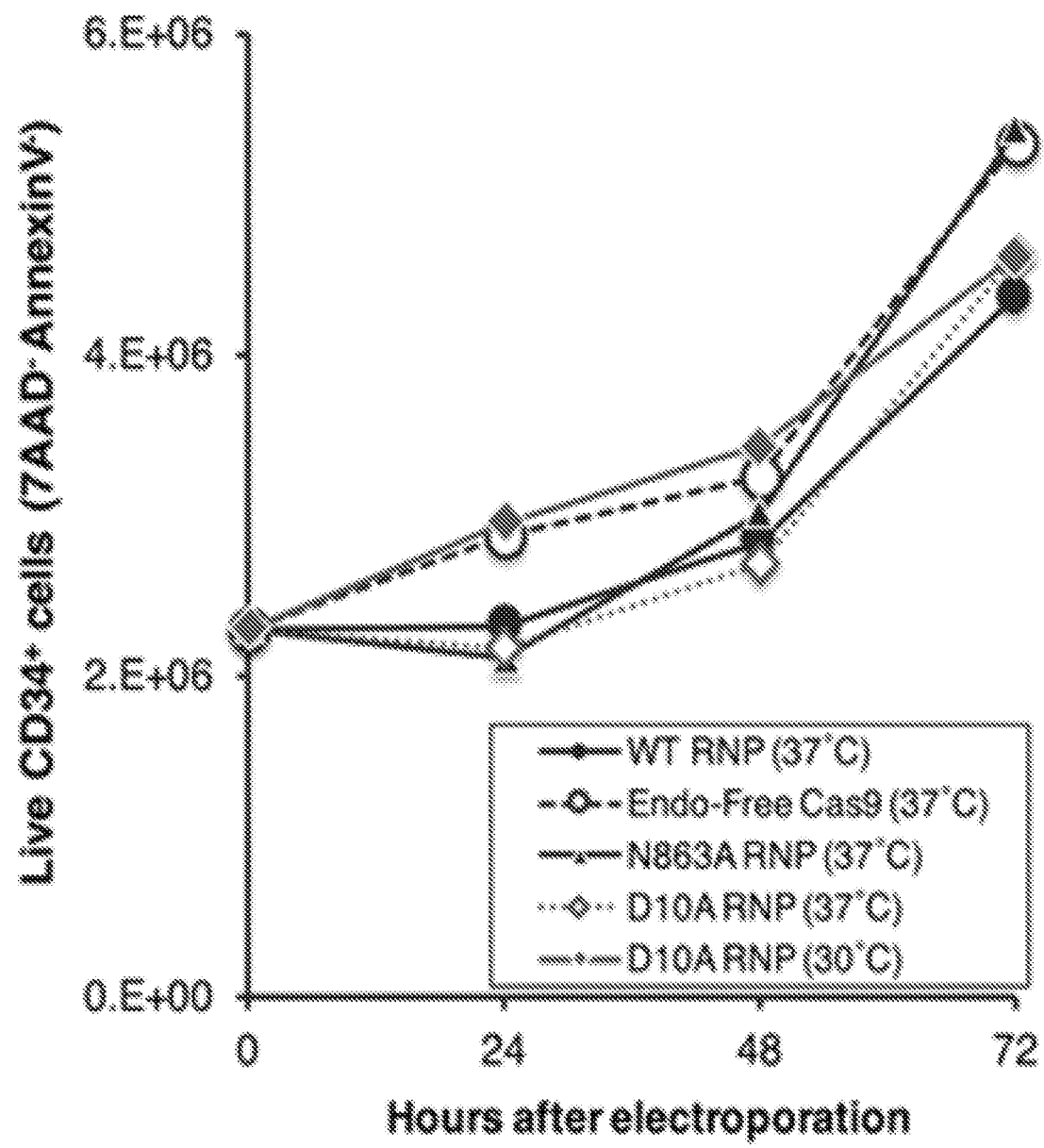
Figure 14B:
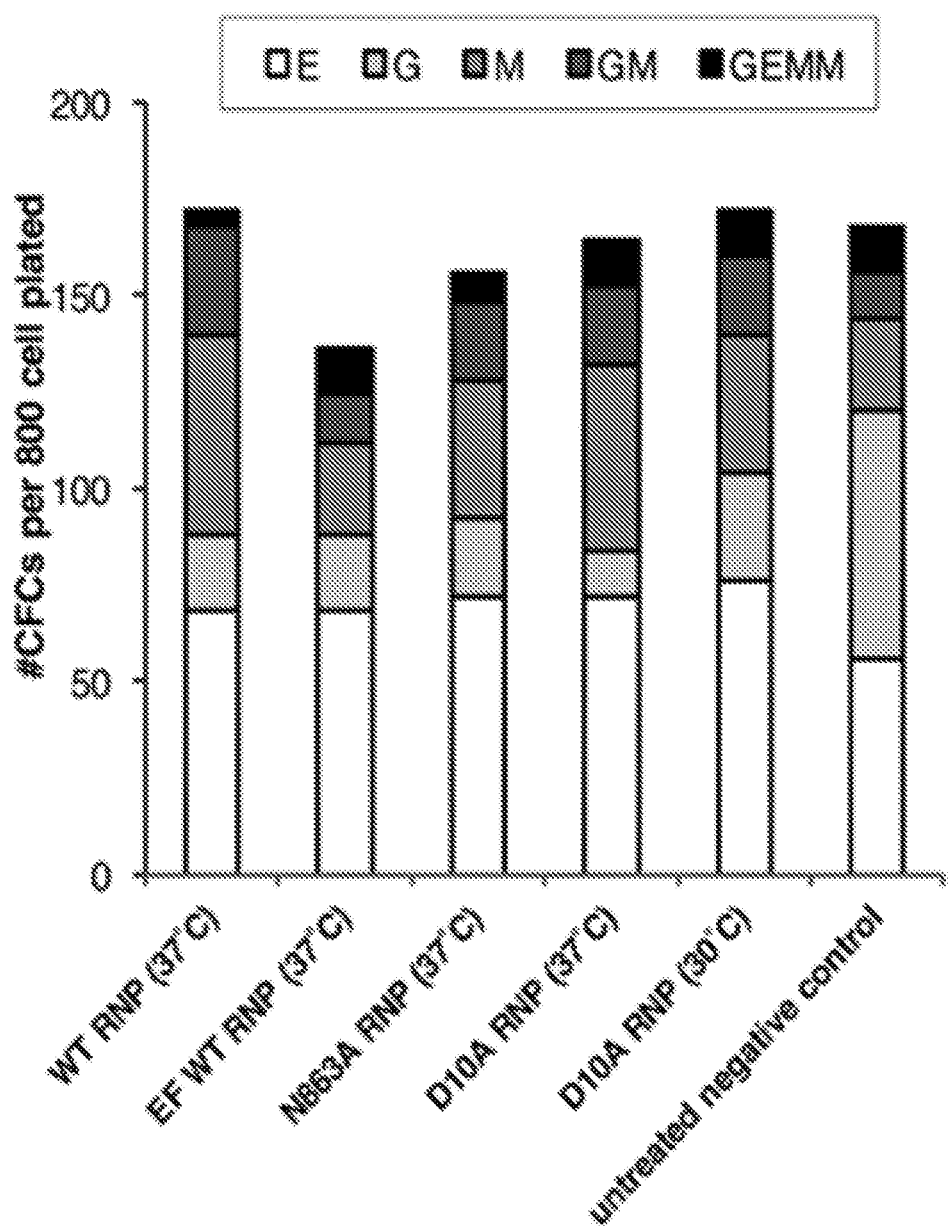

FIGS. 14A and 14B depict that human CB CD34+ HSCs maintain stem cell phenotype after electroporation with Cas9 variant RNPs and HBB targeting gRNA pair. FIG. 14A depicts gene edited human CB CD34+ cells maintained viability after electroporation with WT Cas9 endotoxin-free (EF WT) Cas9, N863A nickase, or D10A nickase co-delivered with HBB gRNA pair. Absolute live (7-AAD$^-$ AnnexinV$^-$) CD34+ cell number at indicated time points relative to electroporation. FIG. 14B depicts that gene edited CB CD34+ cells maintained hematopoietic colony forming cell (CFC) activity and multipotency. E: erythroid, G: granulocyte, M: macrophage, GM: granulocyte-macrophage, GEMM: granulocyte-erythrocyte-macrophage-monocyte CFCs. The amounts of RNP delivered per million cells (10 μg) and the 2-hour recovery temperature (parentheses) after electroporation of the parental human CB CD34+ cells are indicated.

Figures 15A, 15B:
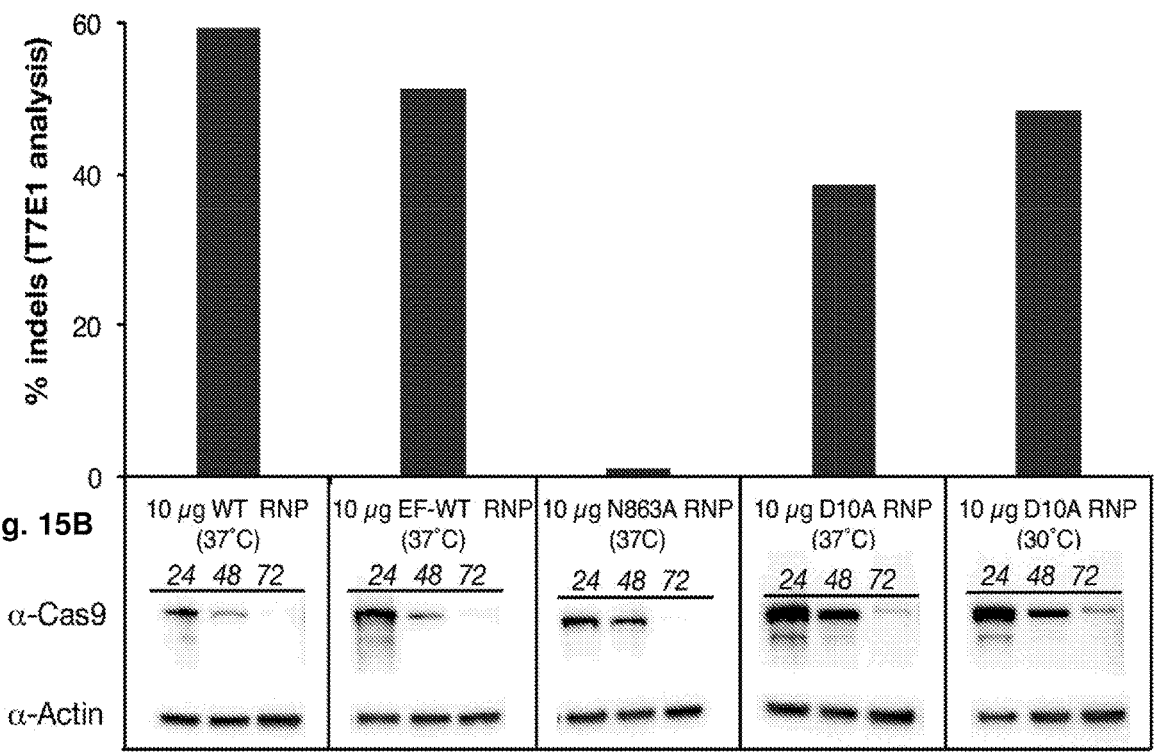

FIGS. 15A and 15B depict a comparison of gene editing at the HBB locus in human CB CD34+ cells mediated by WT and nickase Cas9 variant RNPs. FIG. 15A depicts T7E1 analysis of the percentage of indels detected 72 hours after electroporation at the targeted site in the HBB locus after electroporation of WT Cas9, Endotoxin-free WT Cas9 (EF-WT), N863A nickase, and D10A nickase RNPs, each co-delivered with HBB-8 (SEQ ID NO:388) and HBB-15 (SEQ ID NO:387) gRNA pair. FIG. 15B depicts Western blot analysis showing detection of Cas9 variants in cell lysates of CB CD34+ cells at the indicated time points after electroporation. The amounts of RNP delivered per million cells (10 μg) and the 2-hour recovery temperature (parentheses) after electroporation of the parental human CB CD34+ cells are indicated.

Figure 16A:
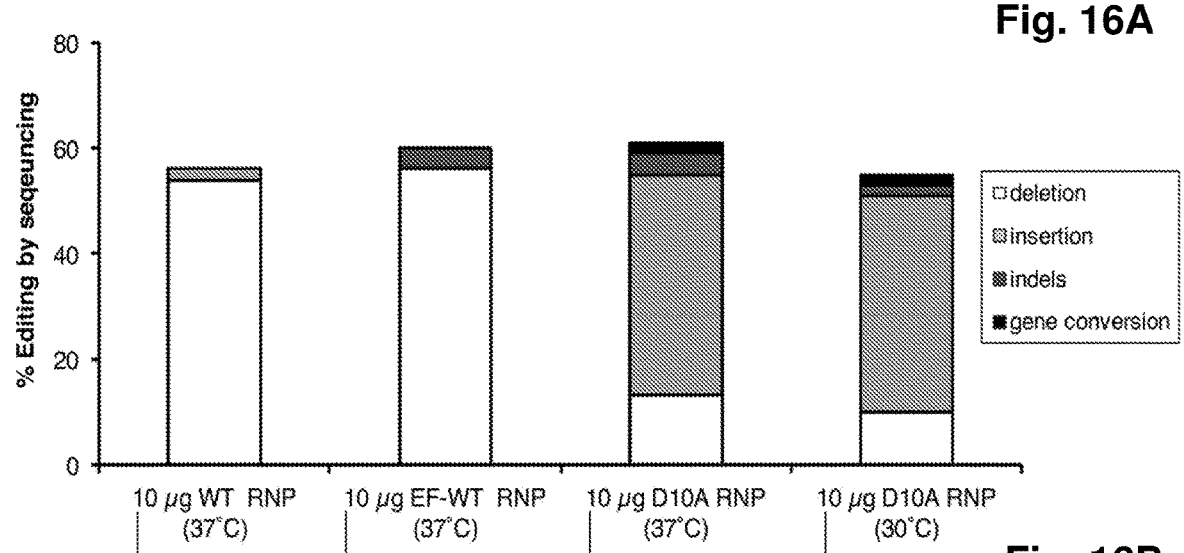
Figure 16B:
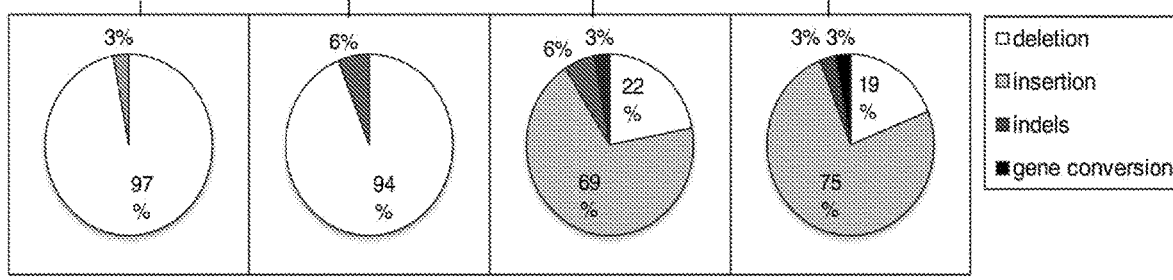

FIGS. 16A and 16B depict a comparison of HDR and NHEJ events detected at the HBB locus after gene editing with WT Cas9 and D10A nickase in human CB CD34+ HSCs. FIG. 16A depicts percentage of gene editing events (72 hours after electroporation) detected by DNA sequencing analysis and shown as a percentage of the total sequence reads. CB CD34+ HSCs received RNP (WT Cas9, Endotoxin-free WT Cas9 (EF-WT), N863A and D10A nickases) with HBB-8 (SEQ ID NO:388) and HBB-15 (SEQ ID NO:387) gRNA pair. FIG. 16B depicts percentages of types of editing events detected in the gDNA from the cells electroporated with the conditions shown in FIG. 16A. Data are shown as a percentage of all gene editing events. Left to Right: 10 μg WT Cas9 RNP (37° C.), 10 μg endotoxin-free (EF) WT Cas9 RNP (37° C.), 10 μg D10A Cas9 RNP (37° C.), 10 μg D10A Cas9 RNP (30° C.).

Figure 17A:
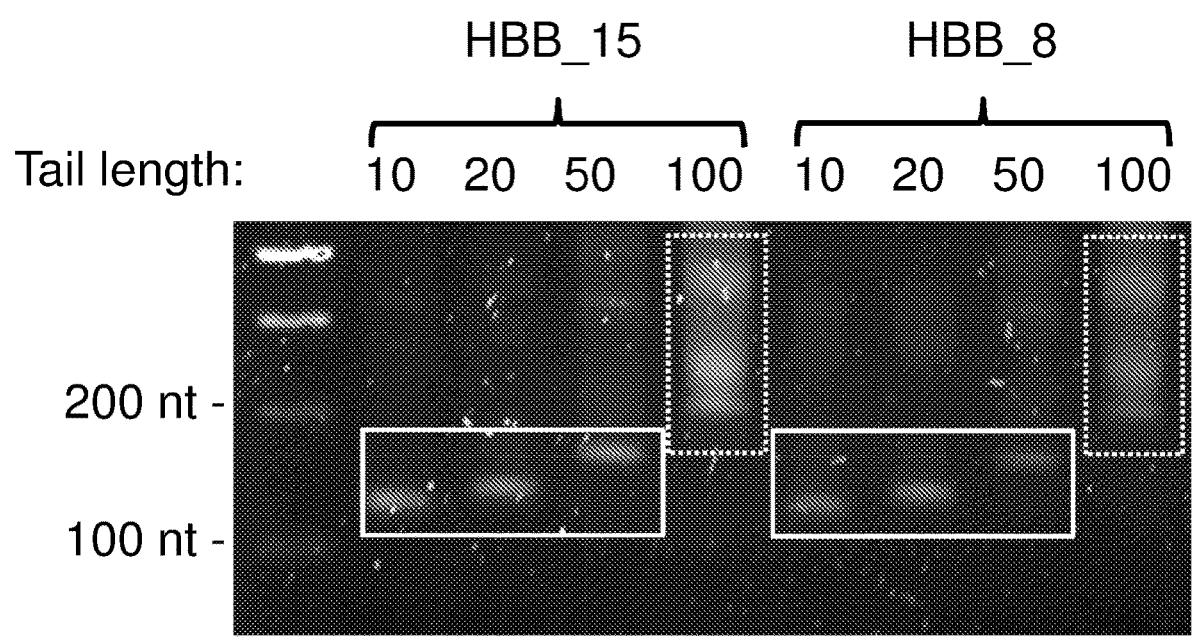
Figure 17B:
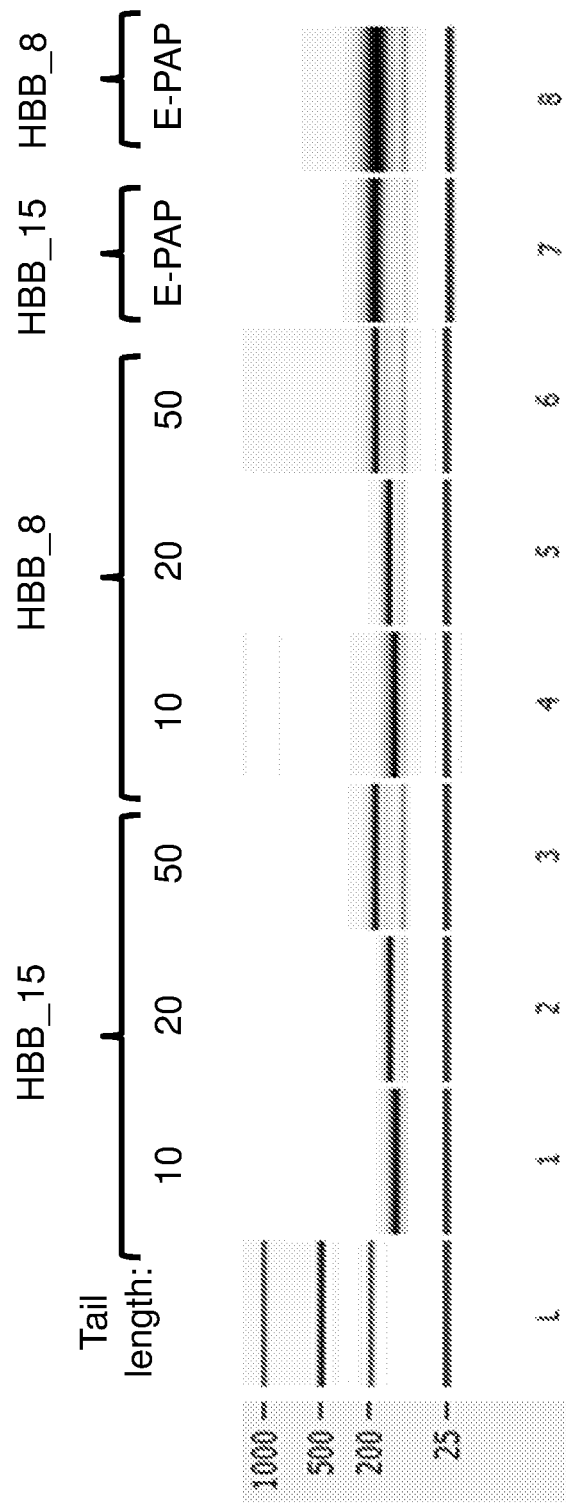

FIGS. 17A-17B depict in vitro transcribed HBB-specific gRNAs generated with polyA tail encoded in DNA template. FIG. 17A depicts PCR products of DNA templates for the HBB gRNAs with encoded polyA tails of the indicated lengths. The dominant size-correct PCR products for gRNAs with 10, 20 and 50 length polyA tails are indicated in the solid boxed area. A distribution of PCR products is shown by dashed boxes. FIG. 17B depicts a bioanalyzer analysis of in vitro transcribed gRNAs with indicated tail lengths engineered in the DNA template or added enzymatically (E-PAP).

Figure 18A:
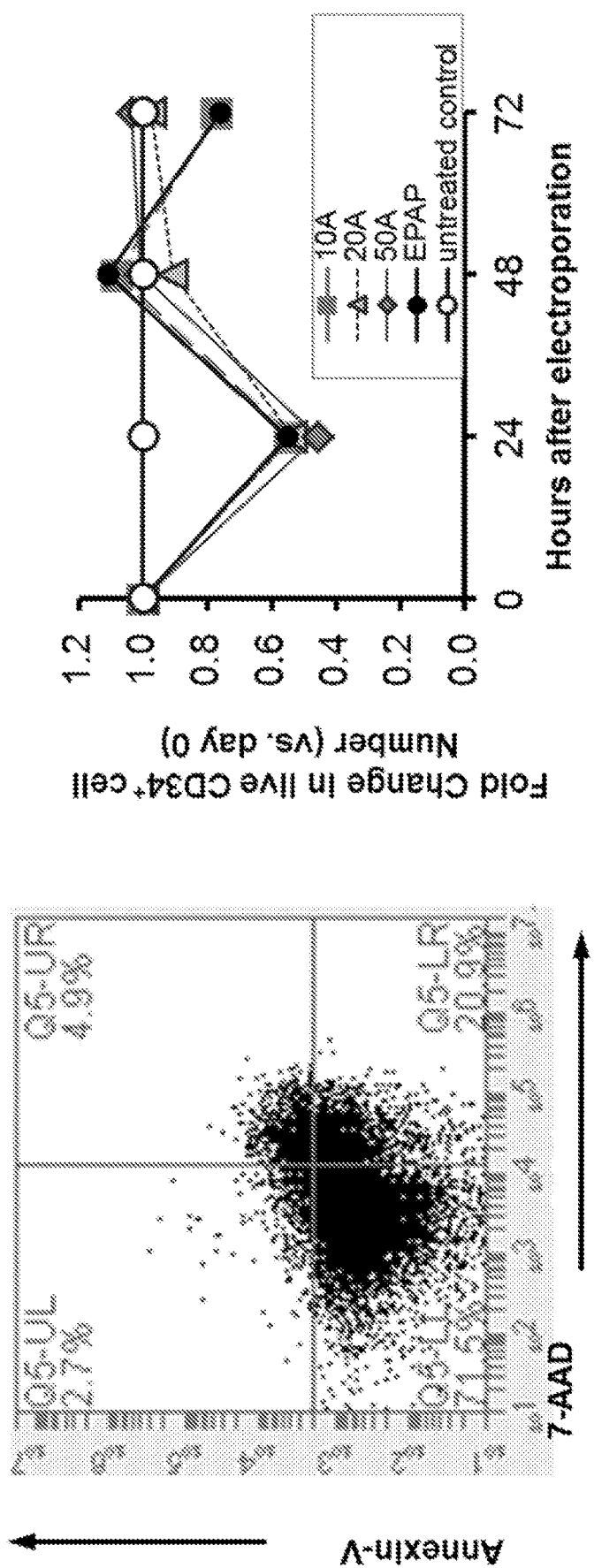
Figure 18B:
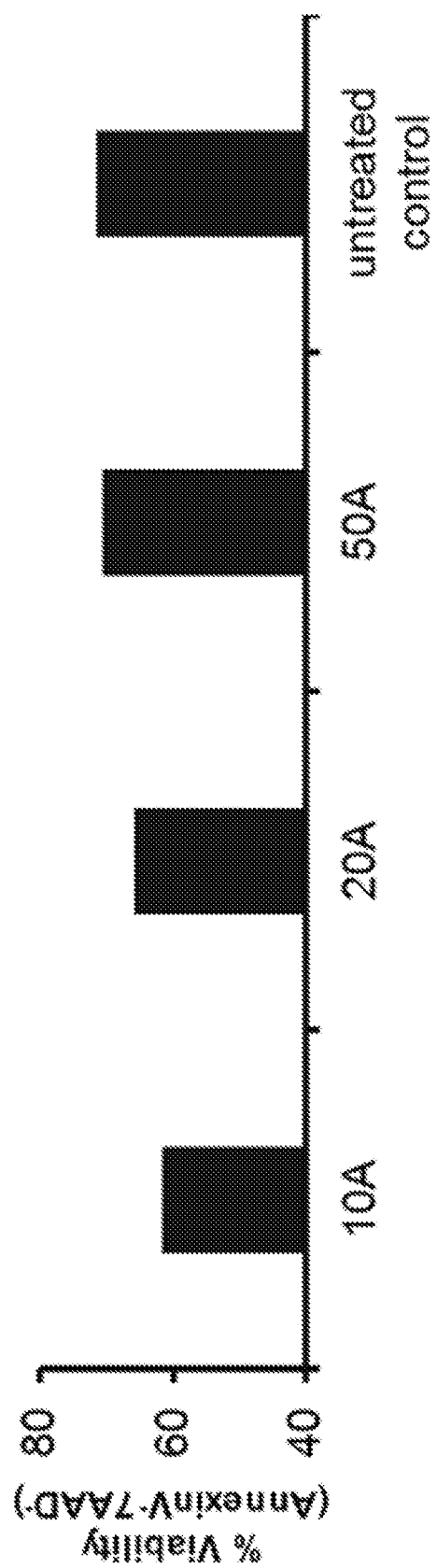
Figure 18C:
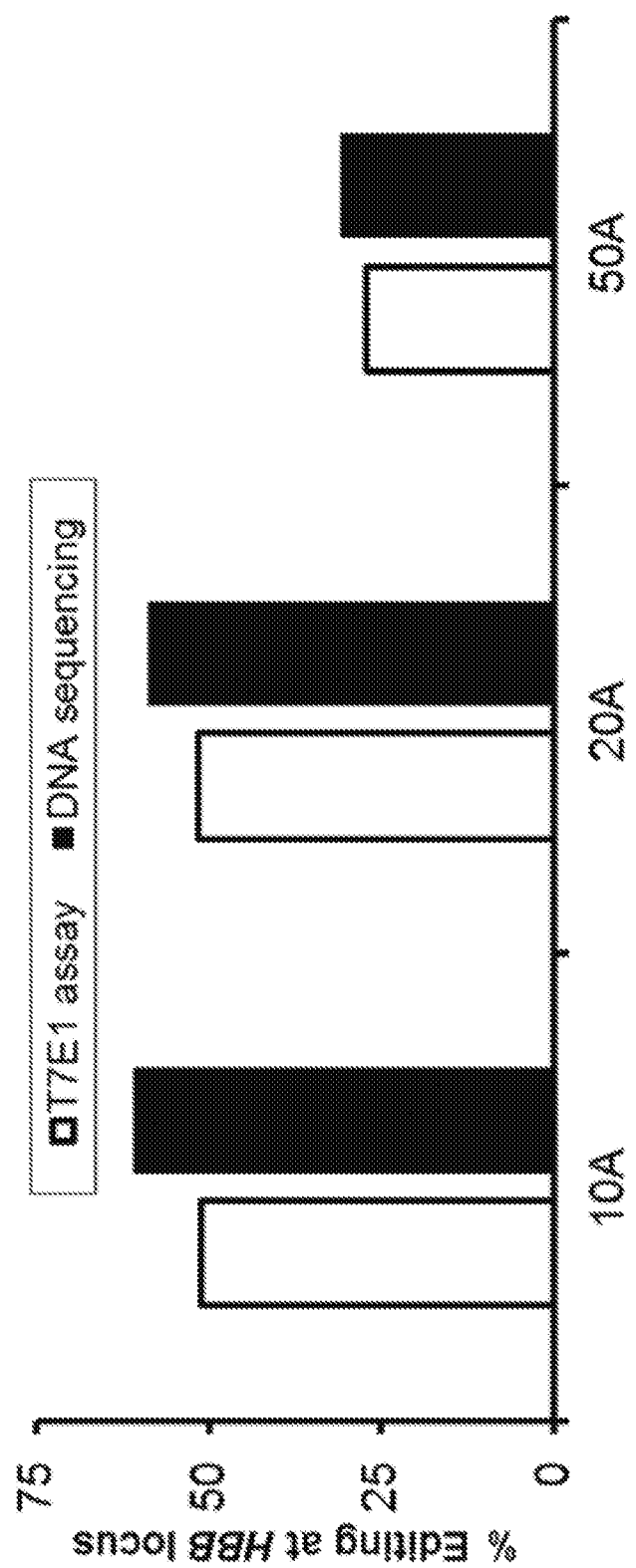

FIGS. 18A-18C depict gRNAs engineered with 10 and 20 length polyA tails supported gene editing in human CB CD34+ HSCs. FIG. 18A left panel depicts a representative flow cytometry analysis plot showing viability (AnnexinV$^-$ 7AAD$^-$) human CB CD34+ HSCs at 72 hours after electroporation with D10A Cas9 RNP with HBB-8 (SEQ ID NO:388) and HBB-15 (SEQ ID NO:387) gRNAs. Right panel: Kinetics of the fold change in the number of CD34+ cells after electroporation with D10A RNP and HBB-8 (SEQ ID NO:388) and HBB-15 (SEQ ID NO:387) gRNAs with indicated polyA tails. FIG. 18B depicts percent viability (AnnexinV$^-$7AAD$^-$) of cord blood CD34+ HSCs at 72 hours after electroporation with D10A RNP and HBB-8 (SEQ ID NO:388) and HBB-15 (SEQ ID NO:387) gRNAs engineered with the indicated tail lengths. FIG. 18C depicts gene editing as detected by T7E1 endonuclease assay and Sanger DNA sequencing of the PCR product of the HBB genomic locus in human CB CD34+ HSCs after electroporation with D10A RNP and HBB-8 (SEQ ID NO:388) and HBB-15 (SEQ ID NO:387) gRNAs with the indicated polyA tails.

FIGS. 19A, 19B, 19C, 19D, 19E, and 19F demonstrate that CRISPR/Cas9 RNP supports highly efficient gene editing at the HBB locus in human adult and cord blood CD34+ hematopoietic stem/progenitor cells from 15 different stem cell donors. (FIG. 19A) Summary of gene editing results as determined by DNA sequencing of composite data from n=15 CD34+ cell donors and 15 experiments. Gene editing is shown for cord blood (CB) and adult mobilized peripheral blood (mPB) CD34+ cell donors. The Cas9 variant (D10A nickase or wild type, WT) are indicated. (FIG. 19B) Summary of types of editing events detected in experiments in which CD34+ cells (n=10 donors) were contacted with D10A nickase RNP and gRNA pair (HBB-8 (SEQ ID NO:388) and HBB-15 (SEQ ID NO:387)). (FIG. 19C) Fold-change in the number of RNP treated and paired untreated control CD34+ cells 2-3 days after electroporation. (FIG. 19D) Composite summary of CFC data indicating the total colonies differentiated from human CD34+ cells, erythroid and myeloid subtypes (n=10 donors). E: erythroid, G: granulocyte, M: macrophage, GM: granulocyte-macrophage, GEMM: granulocyte-erythrocyte-macrophage-monocyte. (FIG. 19E) DNA sequence analysis of HSC clones (erythroid and myeloid CFCs) for detection of wild type DNA sequence (no editing), monoalleleic or biallelic gene editing events at the HBB locus in gDNA from (FIG. 19E) adult mPB CD34+ cells and (FIG. 19F) CB CD34+ cells. Mean and standard deviation are shown for all plots. Paired t-tests were performed for each donor pair represented by the data in panels FIG. 19A-FIG. 19D.

Figure 20A:
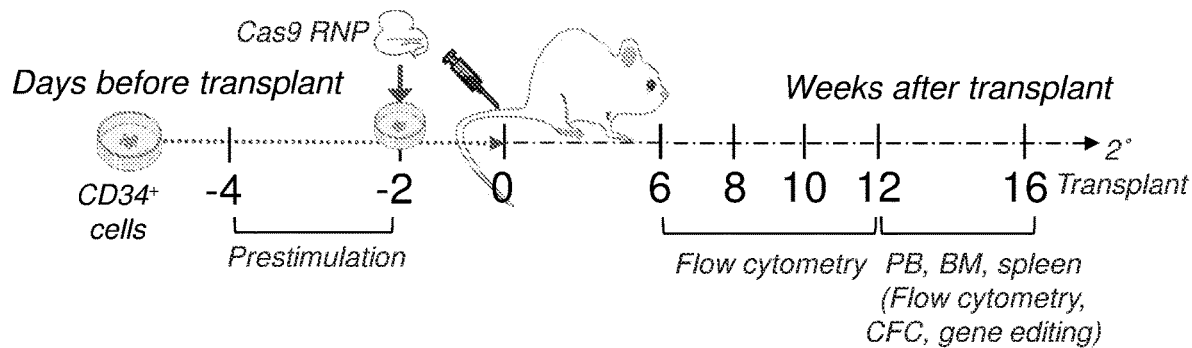
Figure 20B:
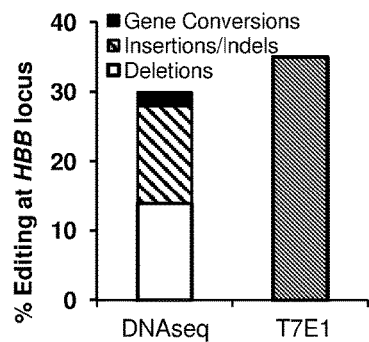
Figure 20C:
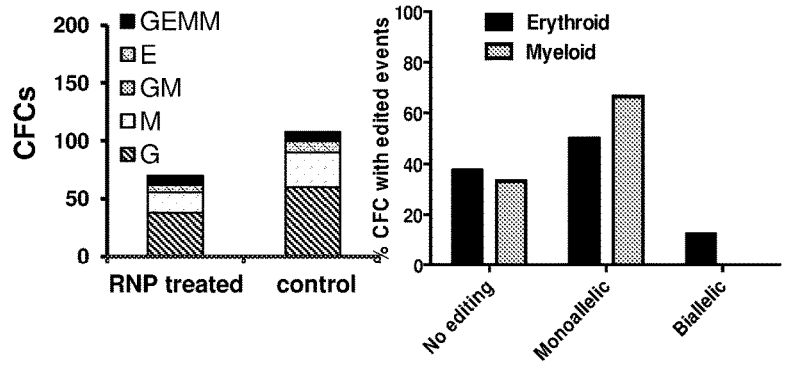
Figure 20D:
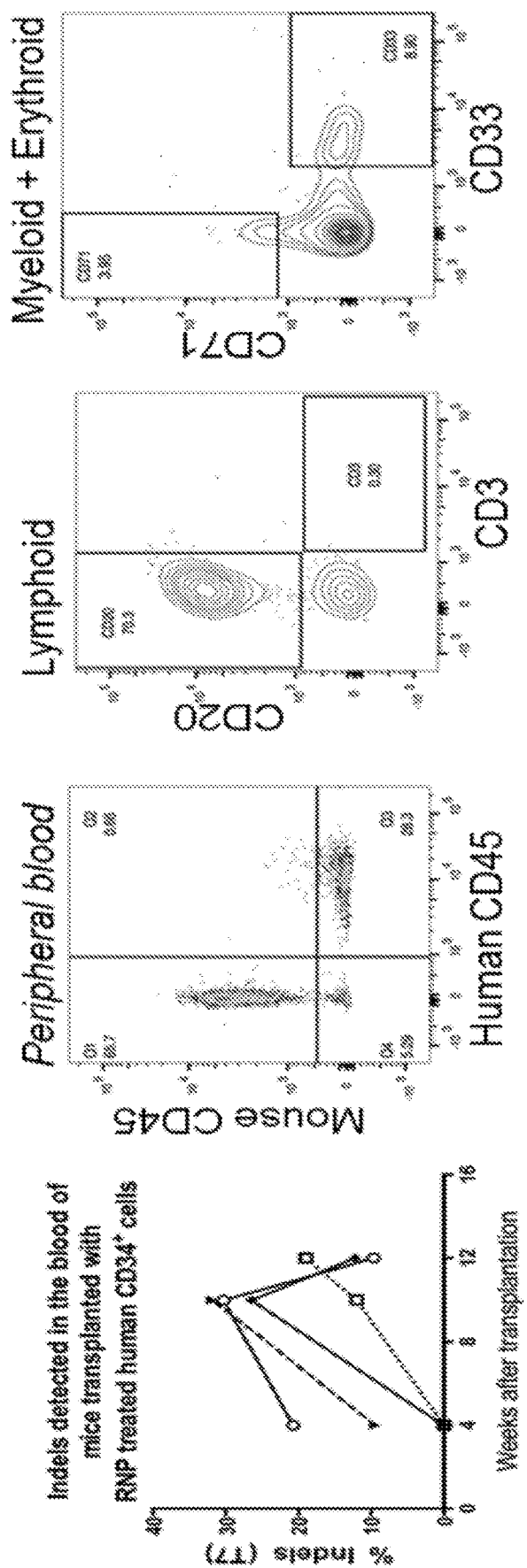
Figure 20E:
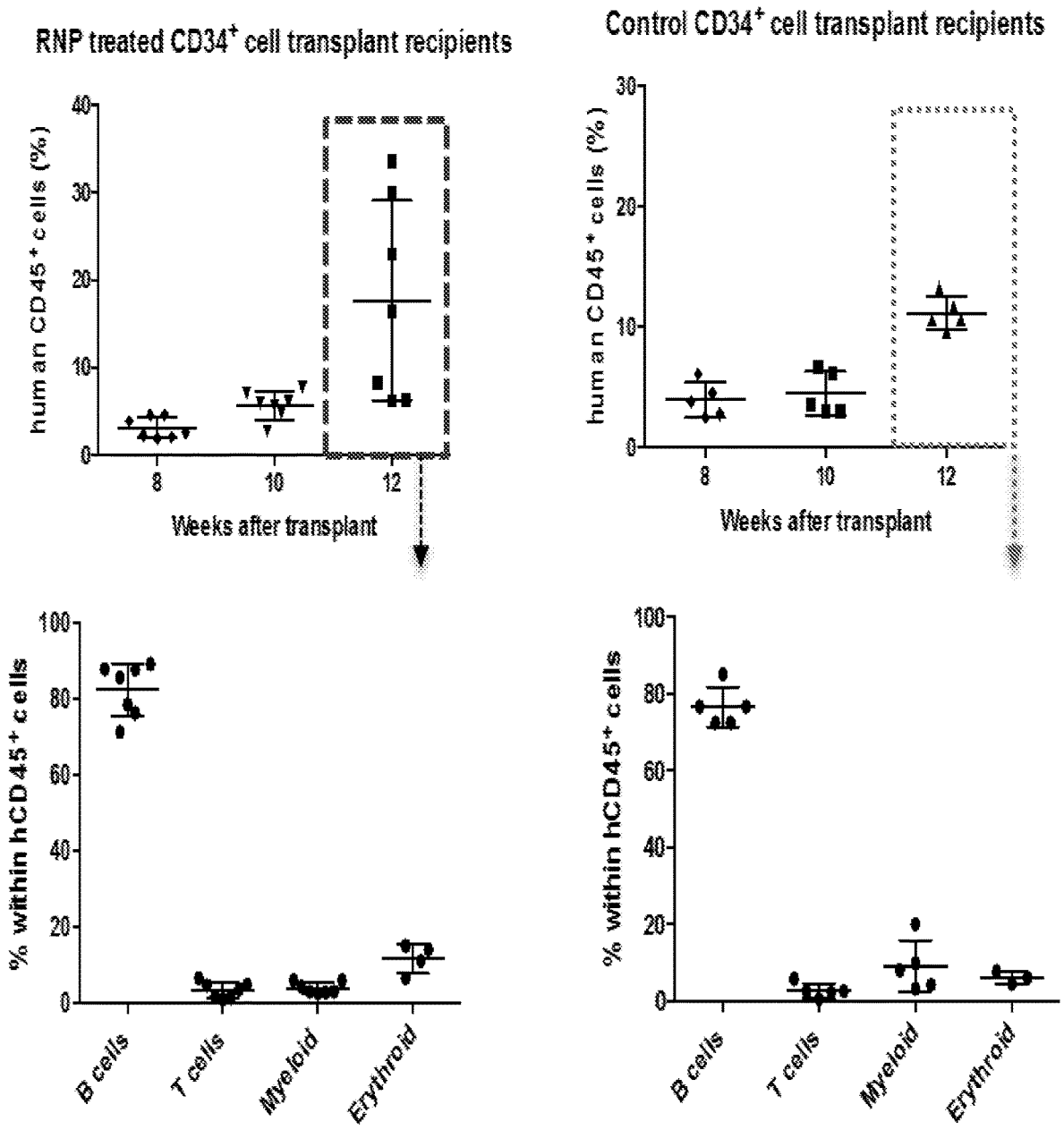

FIGS. 20A, 20B, 20C, 20D, and 20E depict transplantation of Cas9 RNP gene edited human CB CD34+ cells in immunodeficient mouse model. (FIG. 20A) Experimental schematic of RNP delivery to HSCs and transplantation and long-term follow-up in NSG mice. (FIG. 20B) Summary of subtypes of editing events detected in experiments in which fresh CD34+ cells were contacted with D10A nickase RNP and gRNA pair (HBB-8 (SEQ ID NO:388) and HBB-15 (SEQ ID NO:387)) for use in HSC transplantation. (FIG. 20C) Analysis of CFC hematopoietic activity (Left) of gene edited HSCs and DNA sequence analysis (Right) of HSC clones (erythroid and myeloid CFCs) for detection of wild type DNA sequence (no editing), monoalleleic or biallelic gene editing events at the HBB locus in gDNA from CFCs. E: erythroid, G: granulocyte, M: macrophage, GM: granulocyte-macrophage, GEMM: granulocyte-erythrocyte-macrophage-monocyte. (FIG. 20D) Left panel: Detection of indels by T7E1 assay in gDNA extracted from blood samples taken at different time points after cell infusion from mice transplanted with RNP treated human CD34+ cells. Right panel: Detection of human cells in mouse peripheral blood samples. Each line corresponds to the level of gene editing detected in 4 individual mice that were transplanted with RNP treated human CD34+ cells. Representative flow cytometry analysis of peripheral blood sample from RNP treated mouse taken 12 weeks after human HSC transplantation. Human CD45+ cells were distinguished from mouse CD45+ cells in the blood. Human lymphoid and myeloid lineages were detected within the human CD45+ cell gate (FIG. 20E). Kinetics of hematopoietic reconstitution of NSG mice with human CD45+ cells in recipients of RNP treated and control untreated CD34+ cells from the same human HSC donor. Lower panel: percentages of lymphoid and myeloid cells and erythroid progenitors detected in human CD45+ cell gates in transplanted mice.

Figure 21A:
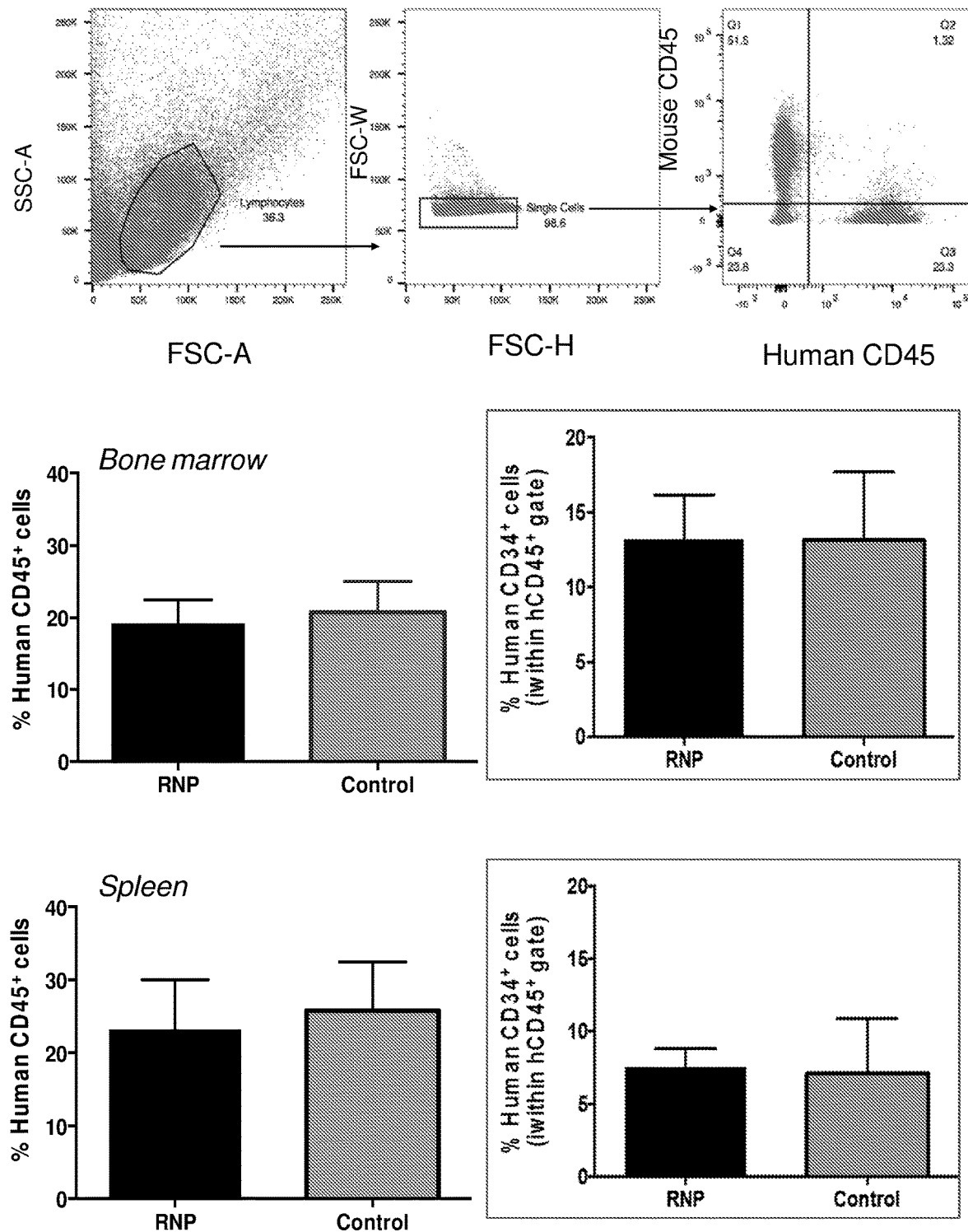
Figure 21B:
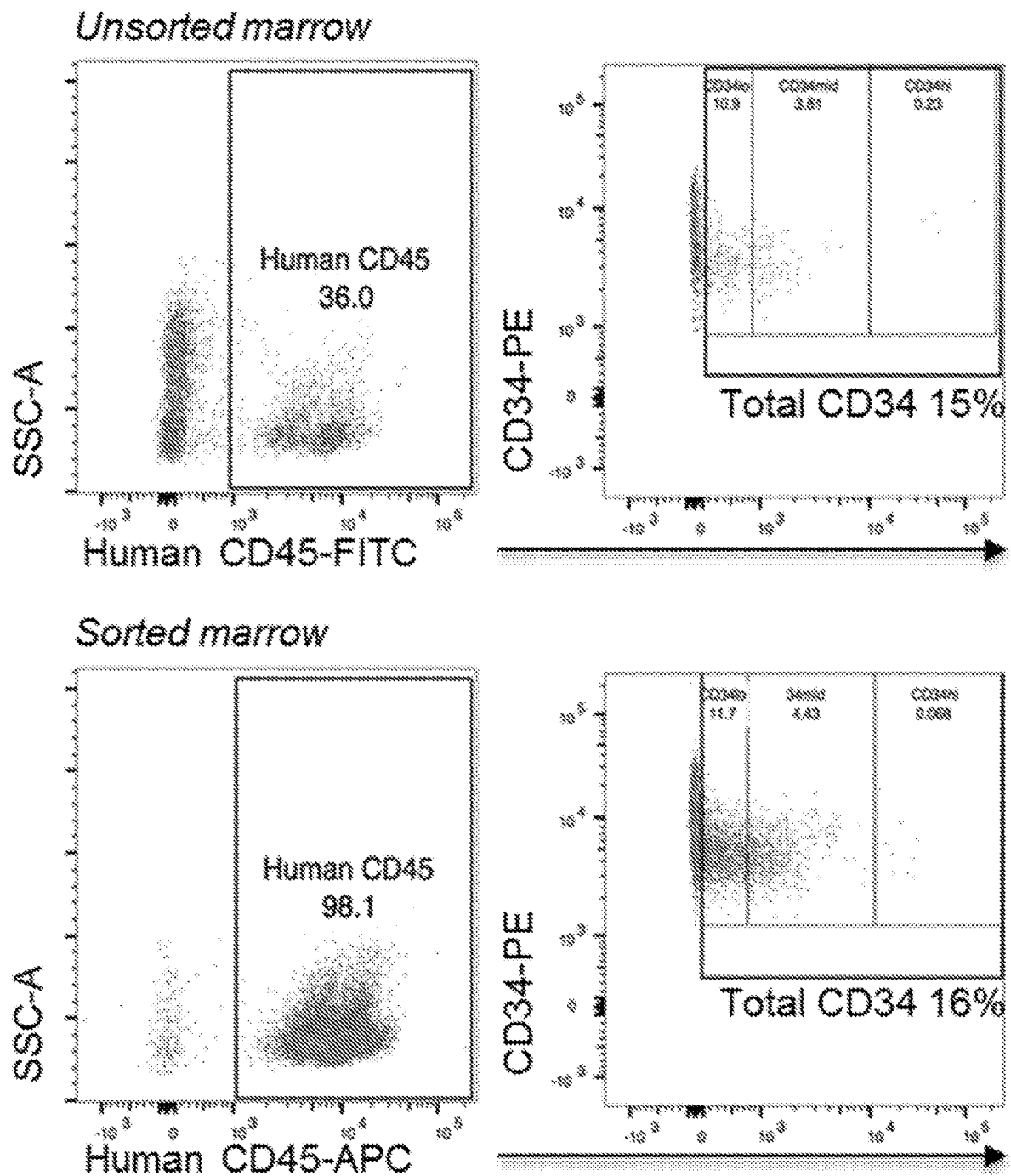
Figure 21C:
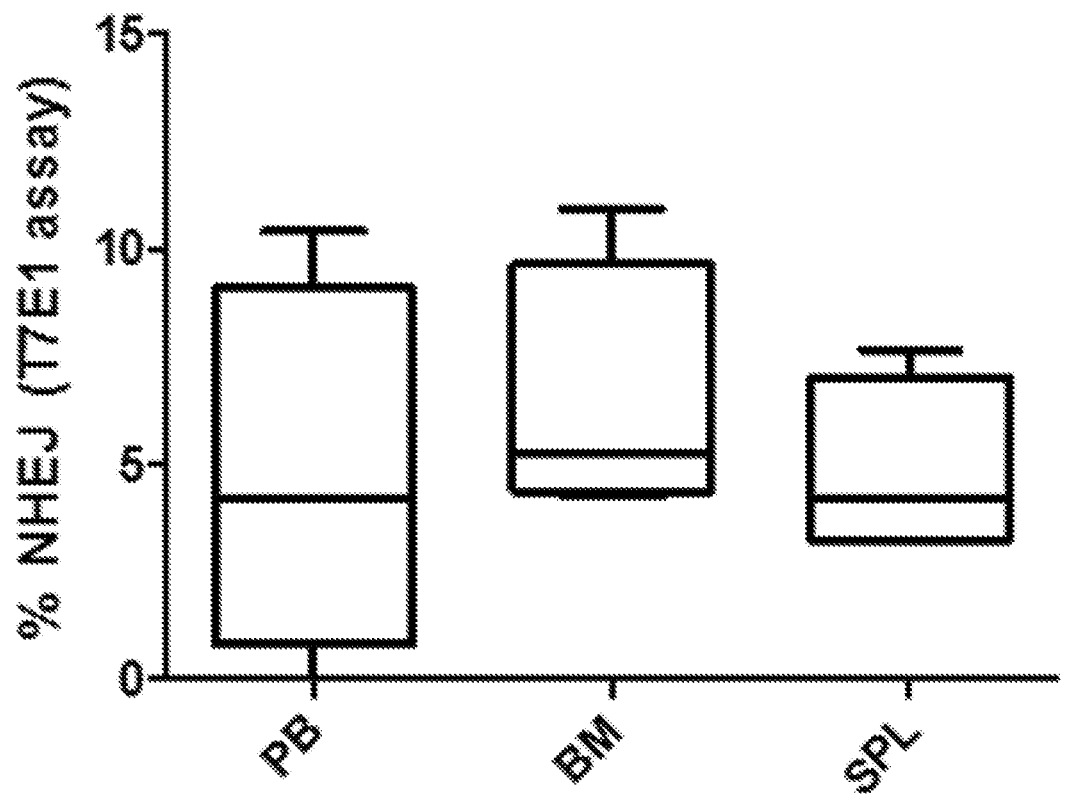

FIGS. 21A, 21B, and 21C depict detection of gene edited human HSCs in the hematopoietic organs of transplanted NSG mice. (FIG. 21A) Representative flow cytometry gating schematic to detected human CD45+ cells in mouse hematopoietic organs. Lower panel: Mean engraftment of human CD45+ cells in the marrow and spleen of the indicated human HSC transplant groups. Right lower panels: Mean percentages of human CD34+ cells detected within the human CD45+ gates in the marrow and spleen of mice. (FIG. 21B) Representative flow cytometry analysis for detection of human CD45+ cells and the human CD34+ cells within the human CD45+ gate of bone marrow from transplanted mice before (top panel) and after (lower panel) of human cell isolation. (FIG. 21C) Gene editing detected by T7E1 analysis in the hematopoietic organs (sorted human cells) and blood samples (unsorted) of mice transplanted with RNP treated HSCs.

Figure 22A:
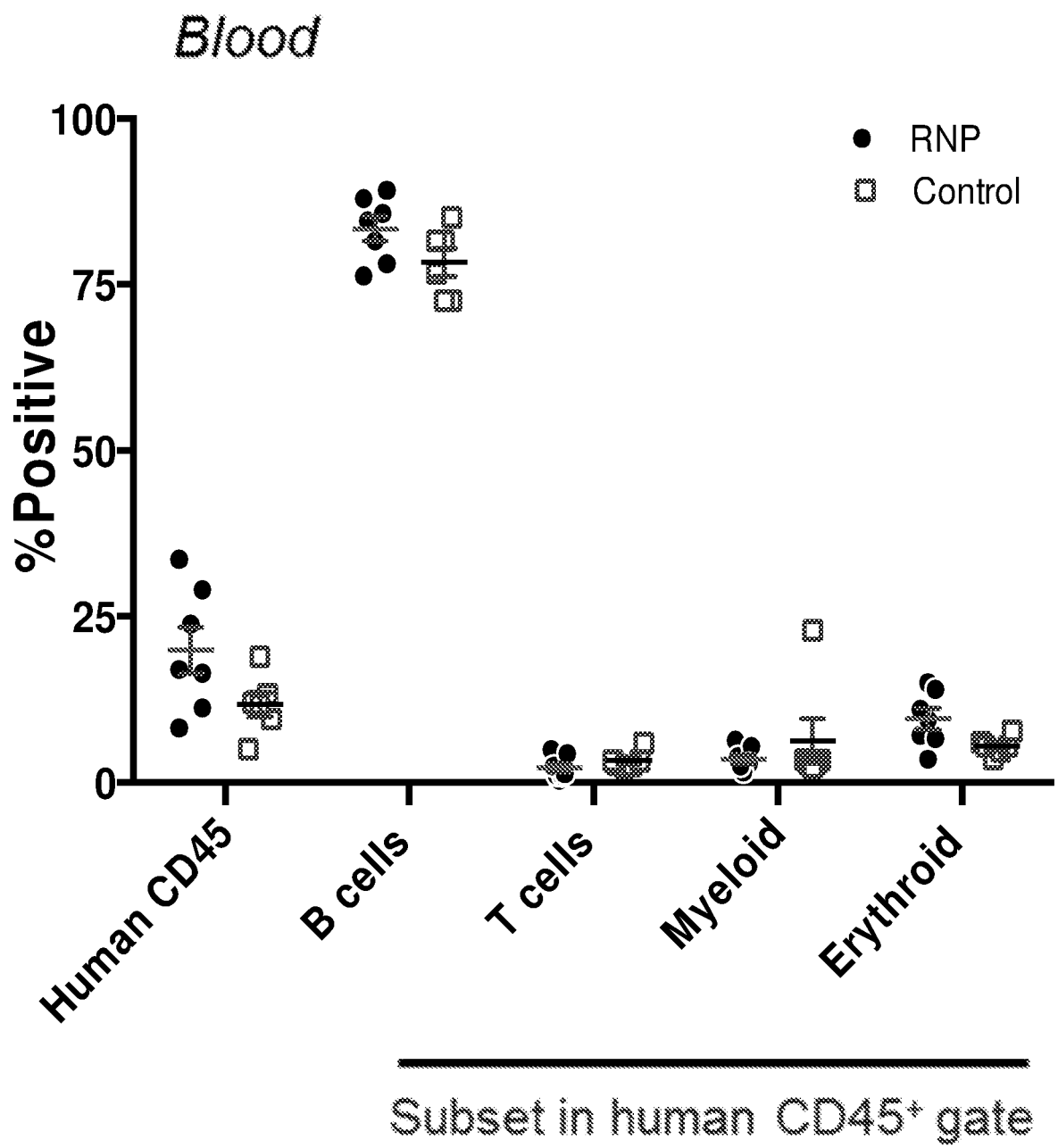
Figure 22B:
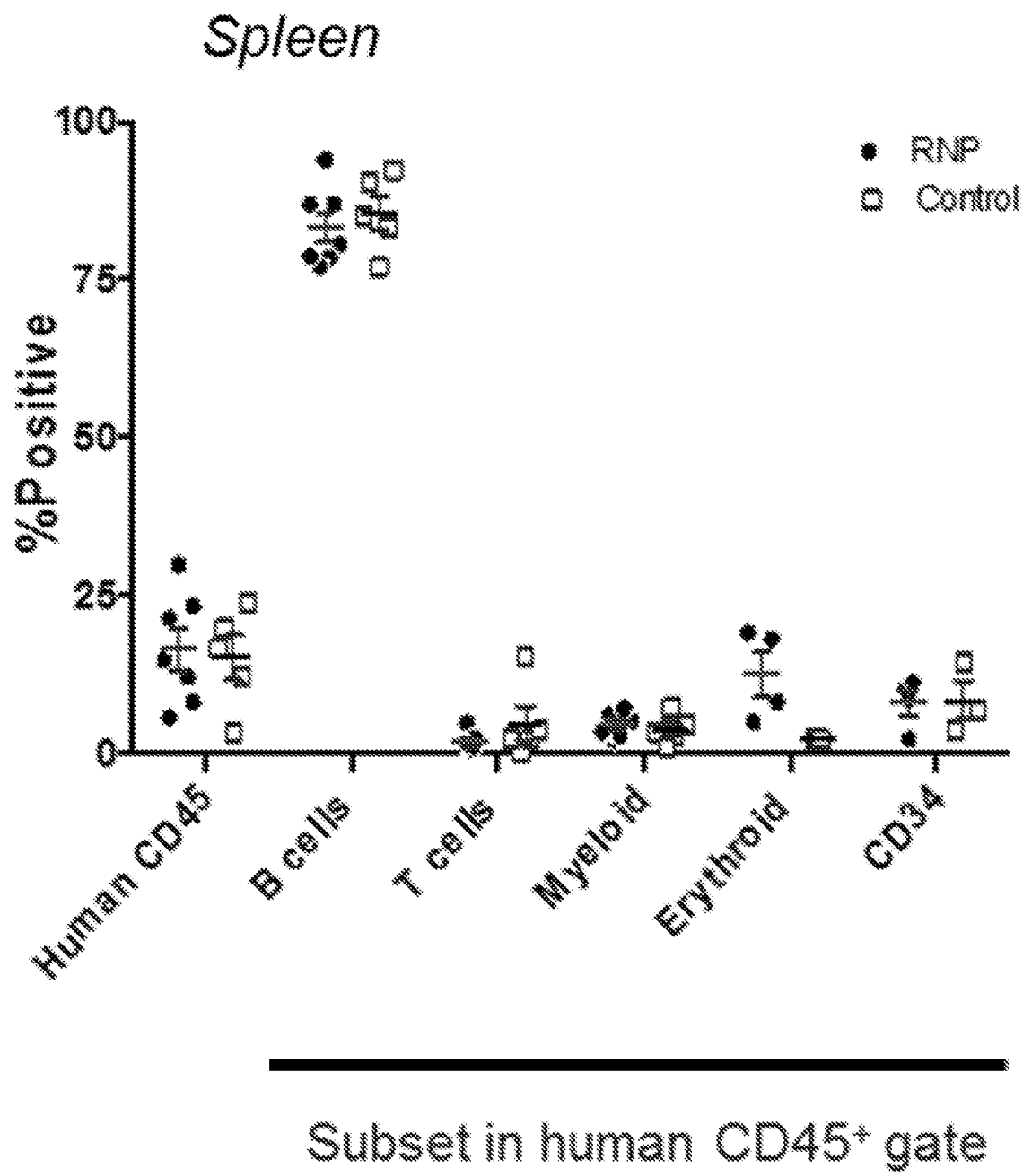
Figure 22C:
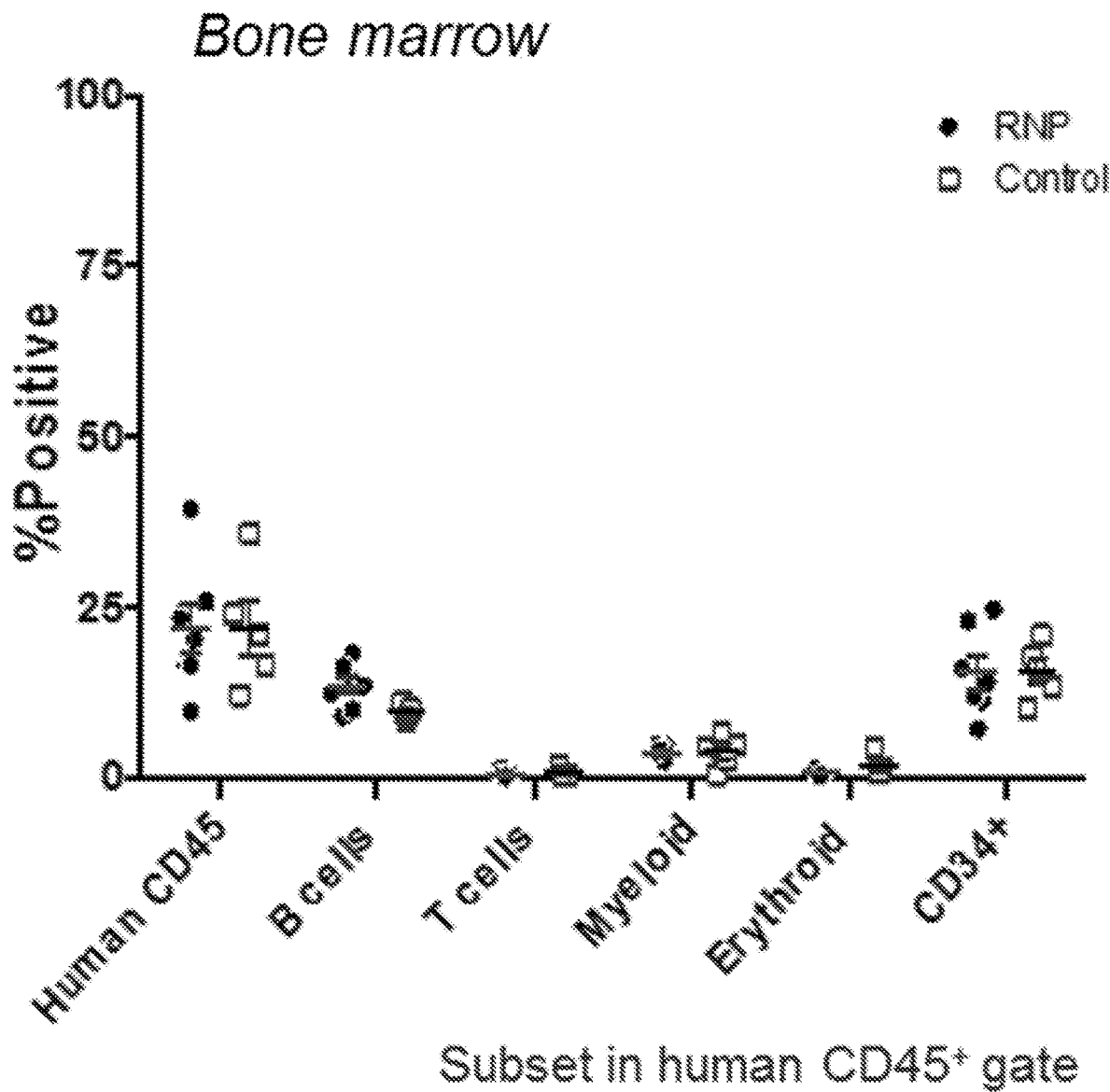

FIGS. 22A, 22B, and 22C depict engraftment of, and gene editing frequency of human CD45+ cells in the peripheral blood, spleen, and bone marrow of immunodeficient NSG mice that were preconditioned with 20 mg/kg busulfan and then transplanted with human umbilical cord blood (CB) CD34+ HSCs that were electroporated with D10A Cas9 HBB-8 and HBB-15 gRNA RNP complexes (RNP). Experiment 1 ("Expt 1", 260,000 cells/mouse) panels depict long-term (4-month) engraftment and gene editing frequency corresponding to the human/mouse xenograft experiment depicted in FIG. 21).

Figure 22D:
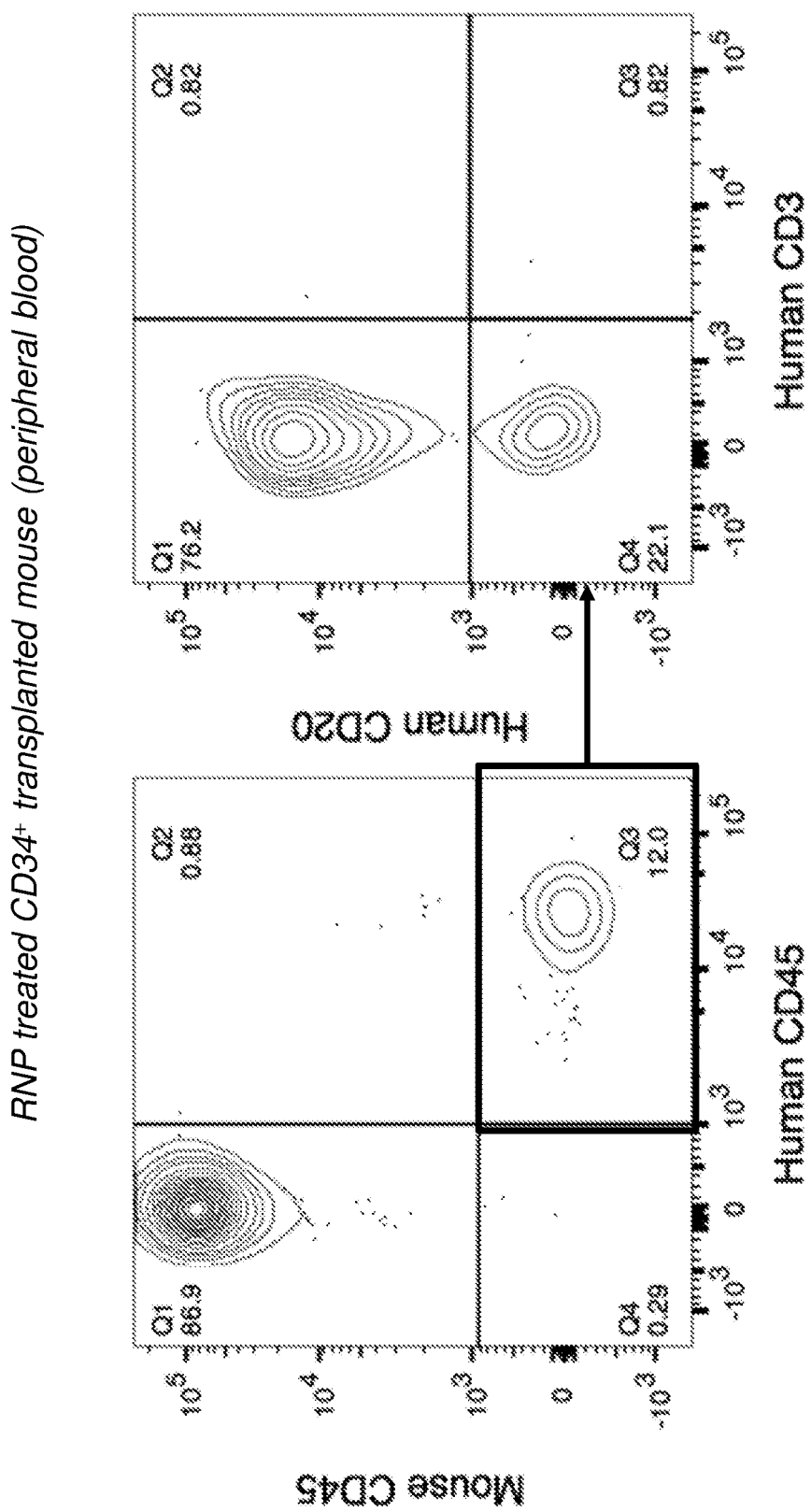

FIG. 22D shows flow cytometry analysis of mouse peripheral blood samples from representative animals of Expt 1 which indicates relative percentages of mouse and human hematopoietic CD45+ cell content in the peripheral blood. Human lymphoid subsets were analyzed within the total human blood (CD45+) cell gates.

Figure 22E:
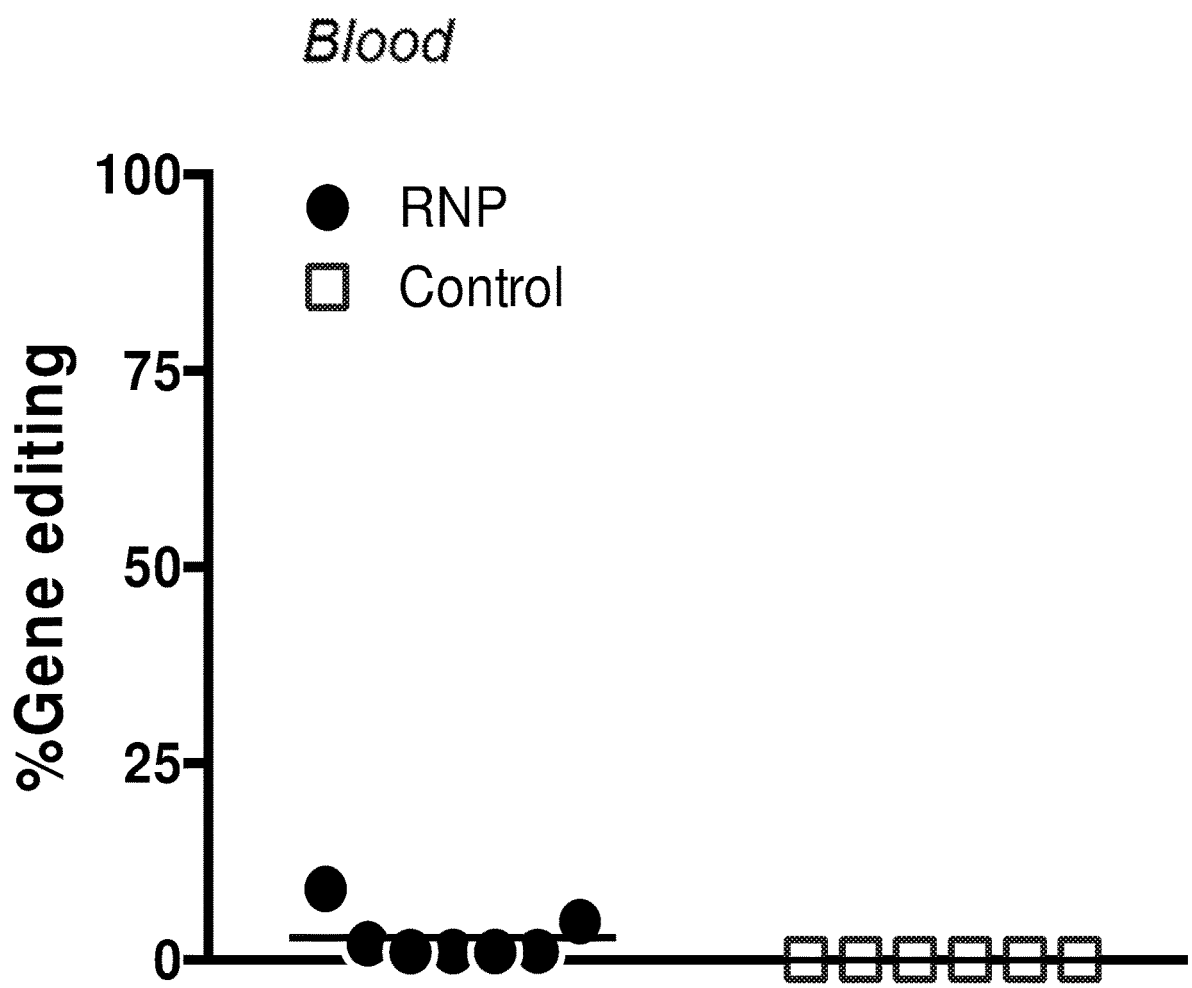
Figure 22F:
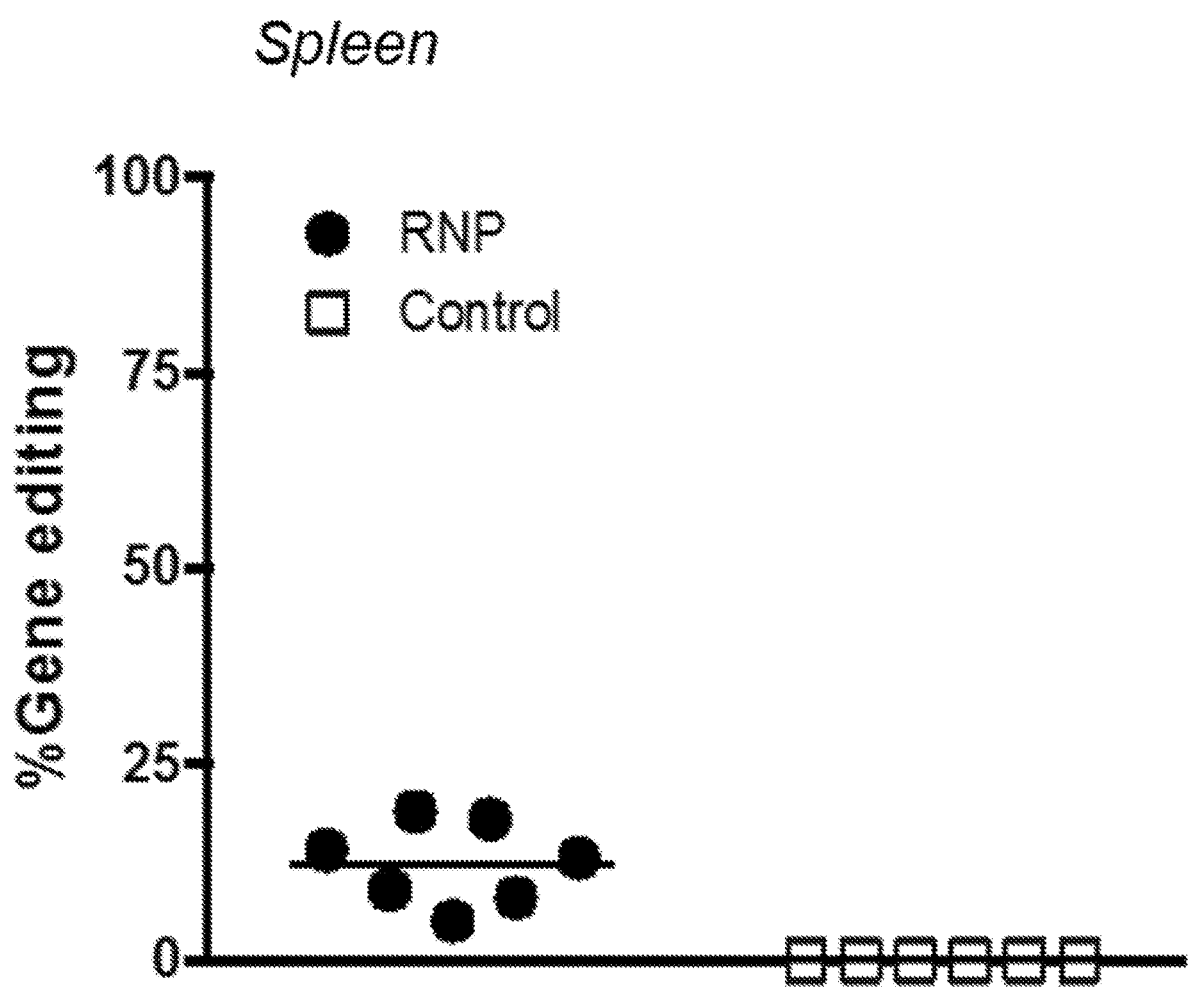
Figure 22G:
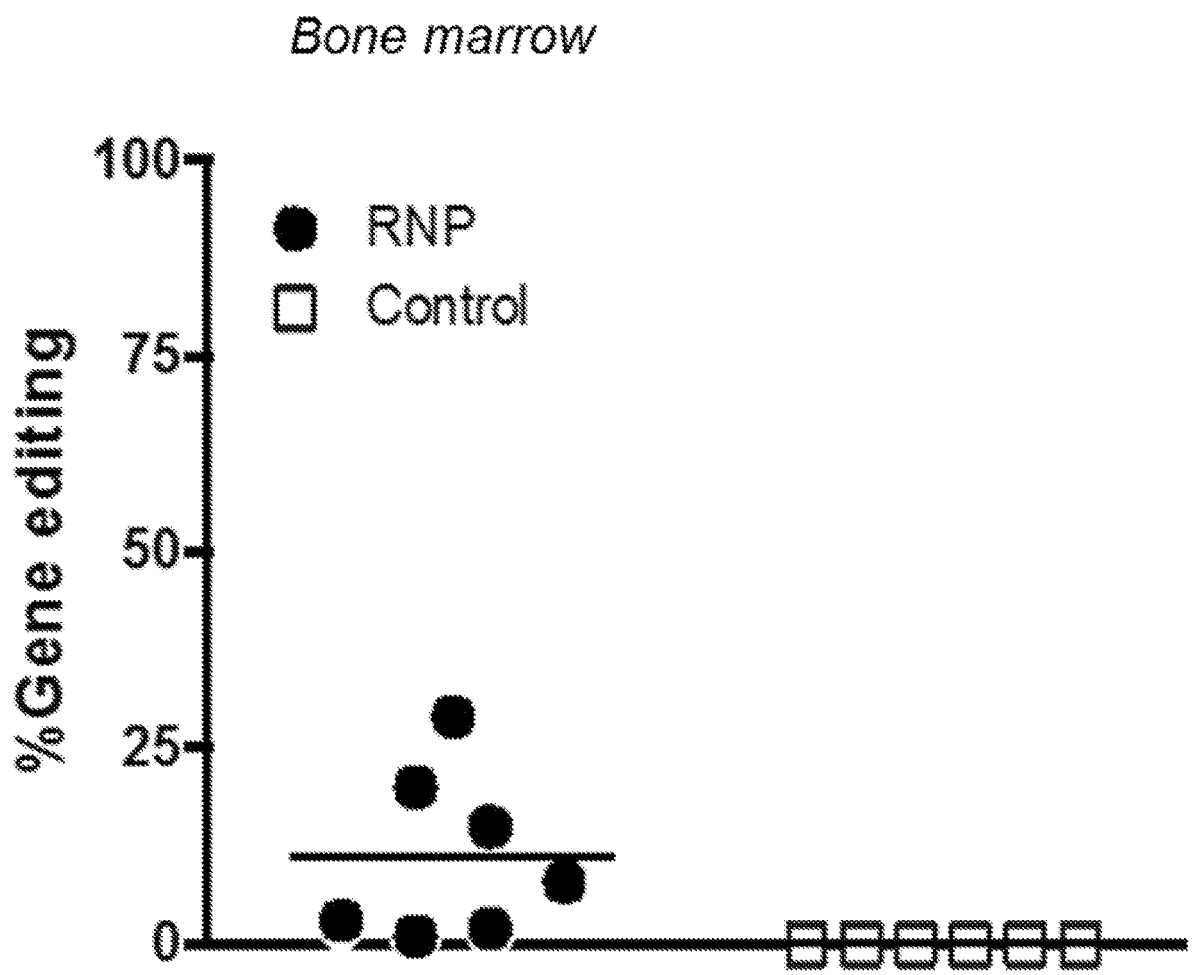

FIGS. 22E, 22F, and 22G show gene editing frequency, as determined by DNA sequencing, in the blood, spleen, and bone marrow 16 weeks after HSC transplantation.

Figure 22H:
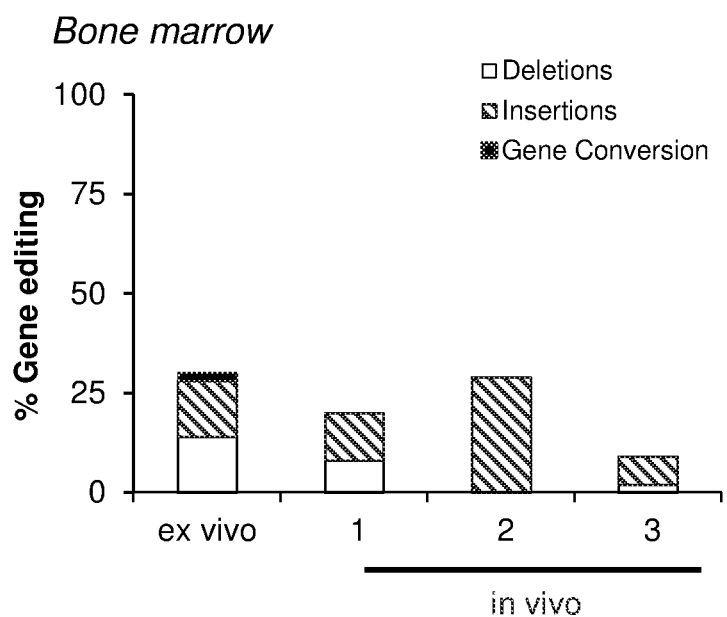
Figure 22I:
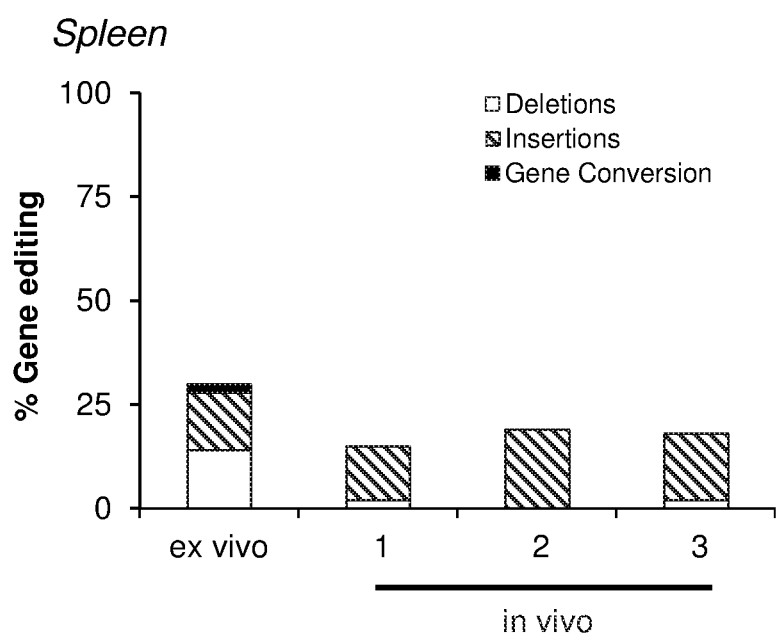

FIGS. 22H and 22I show the frequency of specific types of gene editing events detected in the sorted human cells from bone marrow and spleen of representative RNP-HSC transplant recipients from each group. Total gene editing frequency, as determined by DNA sequencing analysis, and the types of gene editing event, detected in human cells that were enriched from the spleen and bone marrow of mice transplanted with RNP treated human CD34+ cells 4 months prior. The frequency of gene editing that was detected in the pre-infusion (ex vivo) cell product prior to transplantation and the frequency of gene editing detected in vivo in representative transplant recipients is shown.

Figure 23A:
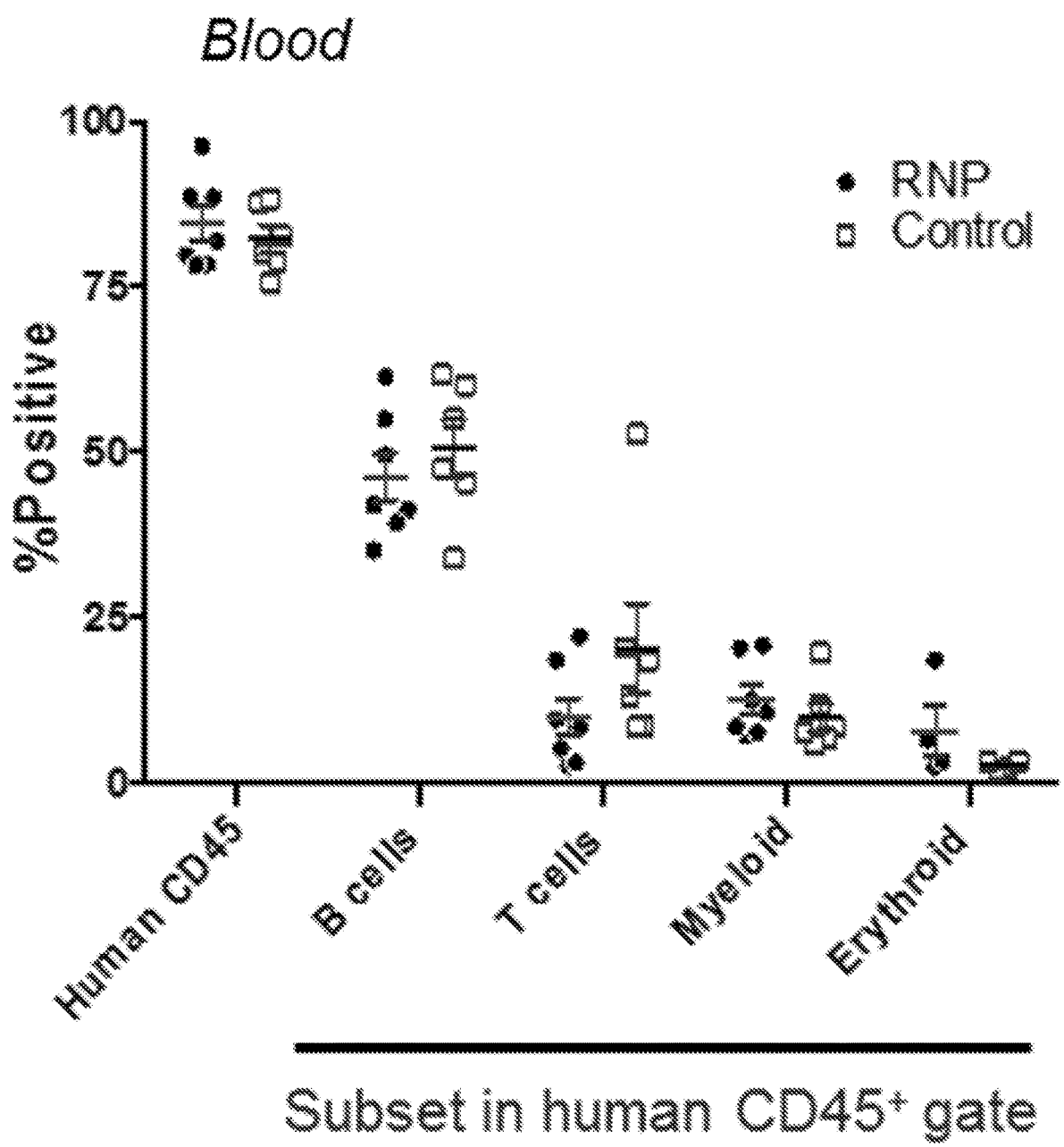
Figure 23B:
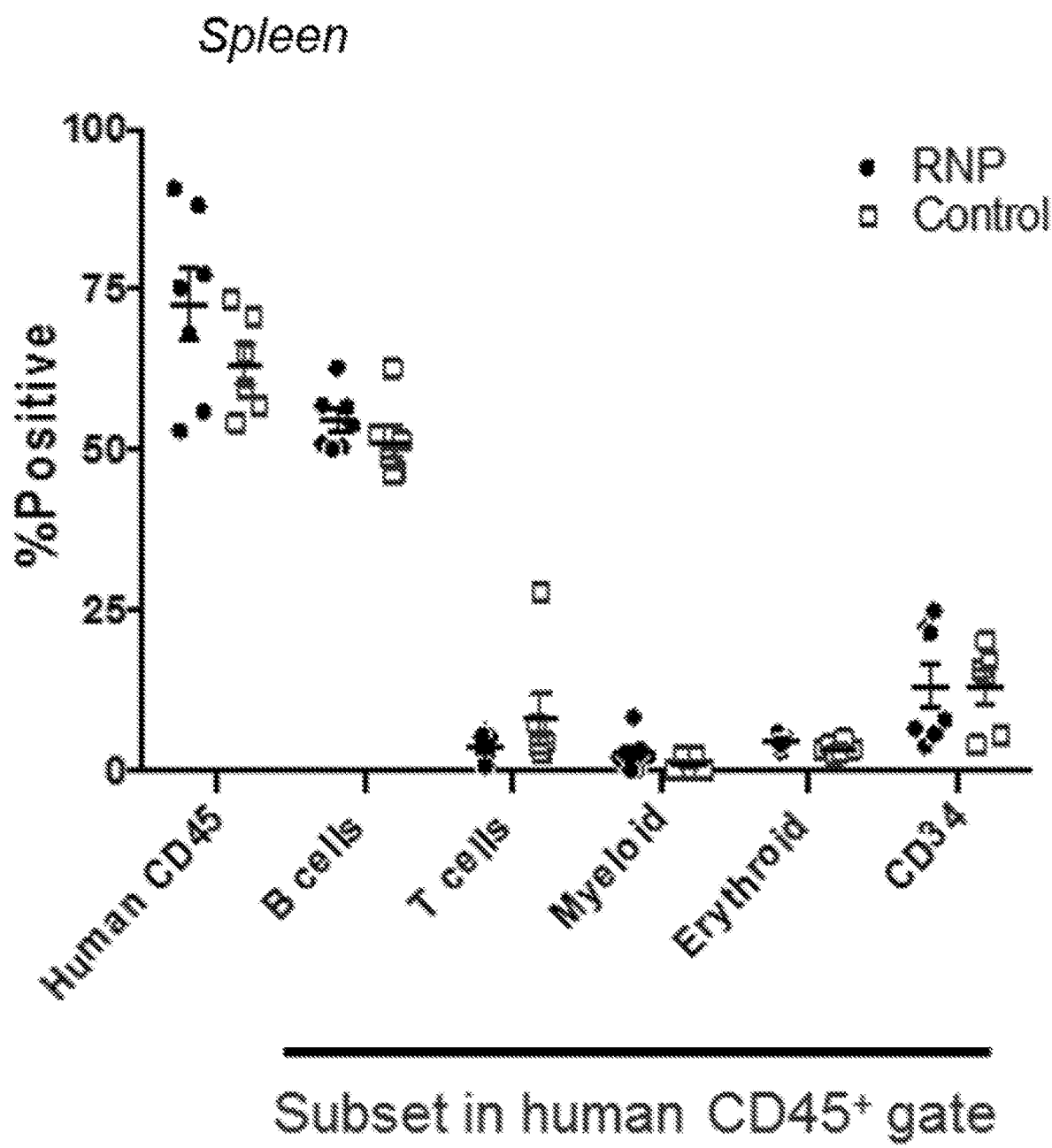
Figure 23C:
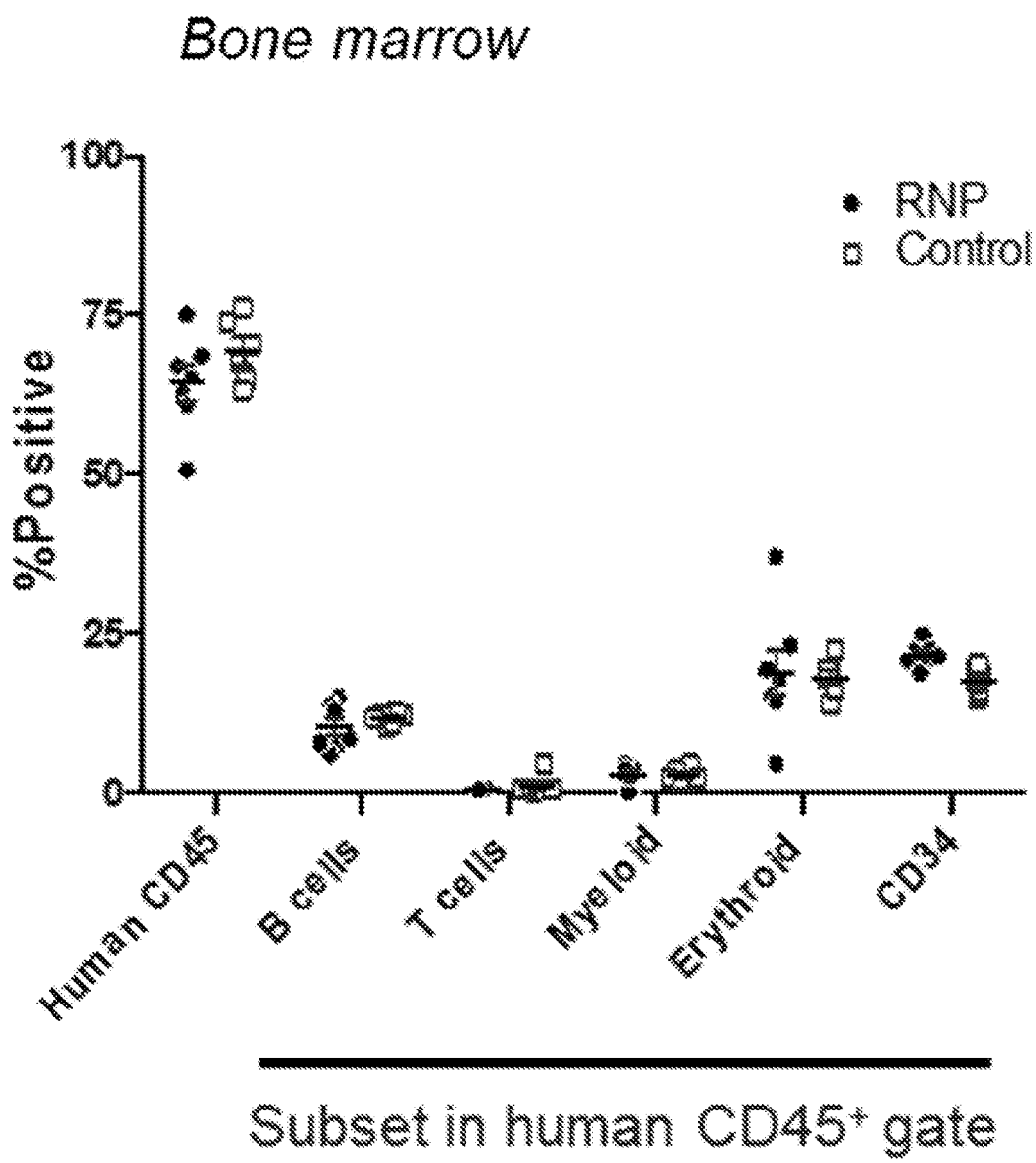

FIGS. 23A, 23B, and 23C depict engraftment of, and gene editing frequency in, human CD45+ cells in the peripheral blood, spleen, and bone marrow of immunodeficient NSG mice that were preconditioned with 25 mg/kg busulfan and then transplanted with human umbilical cord blood (CB) CD34+ HSCs that were prestimulated in media with cytokines plus PGE2 and SR-1, electroporated with D10A Cas9 with HBB-8 (SEQ ID NO:388) and HBB-15 (SEQ ID NO:387) RNP complexes, and then cultured for an additional 2 days in media with cytokines plus PGE2 and SR1. For Experiment 2 ("EXPT 2") each animal received 570,000 cells. All panels depict long-term (16 week or 4-month) engraftment.

Figure 23D:
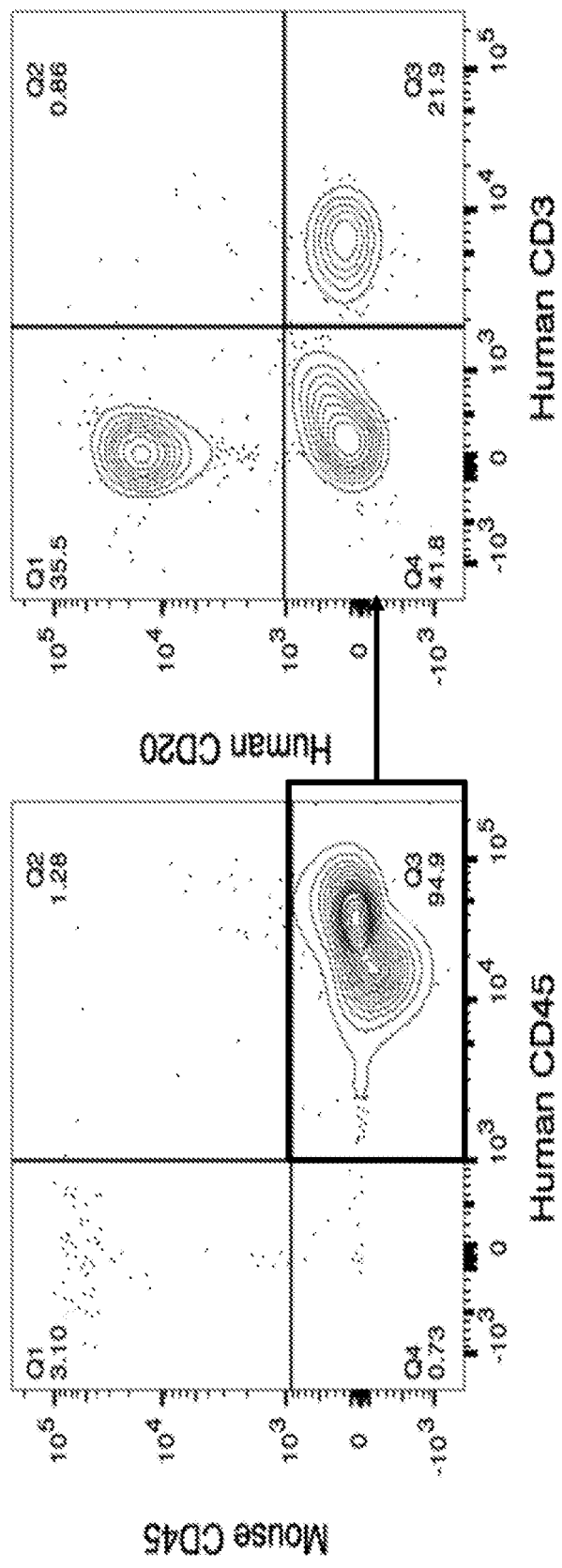

FIG. 23D shows flow cytometry analysis of mouse peripheral blood samples from a representative animal from EXPT 2 which indicates relative percentages of mouse and human hematopoietic CD45+ cell content in the peripheral blood. Human lymphoid subsets were analyzed within the total human blood (CD45+) cell gates.

Figure 23E:
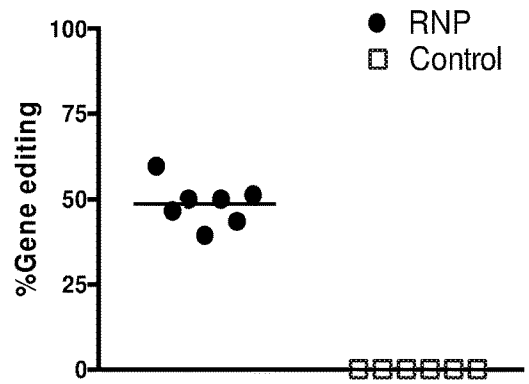
Figure 23F:
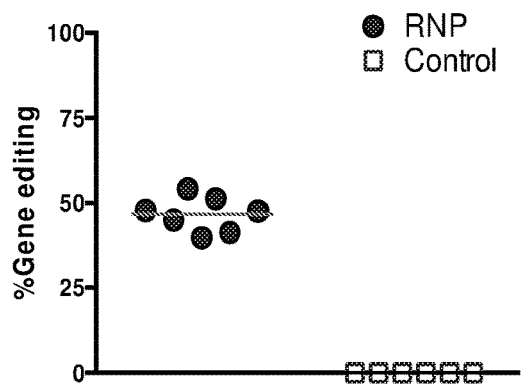
Figure 23G:
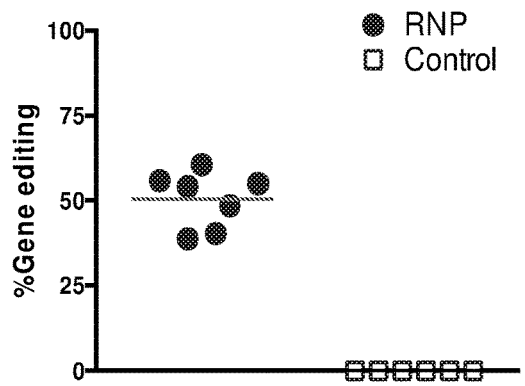

FIGS. 23E, 23F and 23G show gene editing frequency, as determined by DNA sequencing, in the blood, spleen, and bone marrow 16 weeks after HSC transplantation.

Figure 23H:
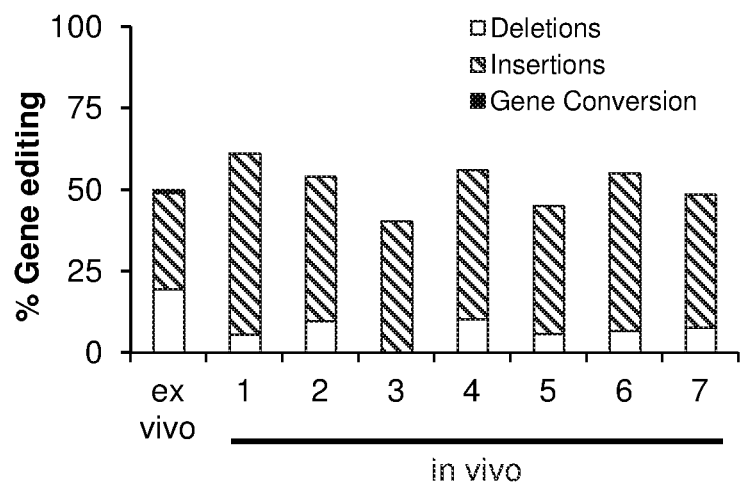
Figure 23I:
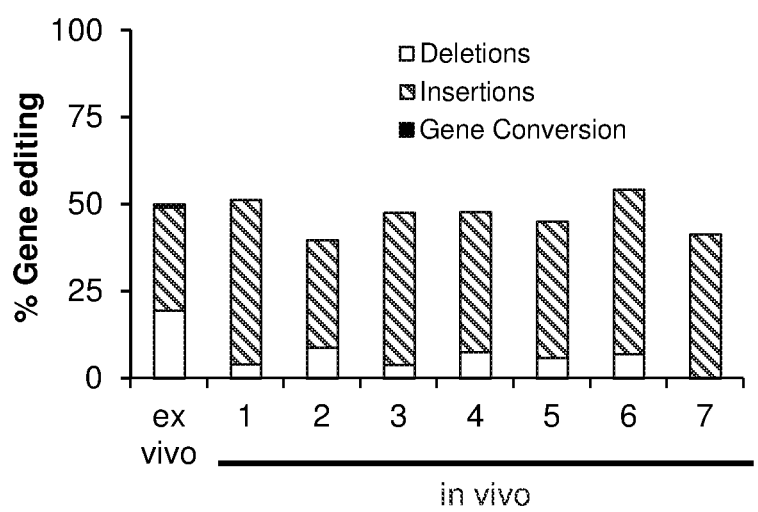

FIGS. 23H and 23I show the specific types of gene editing events detected in the sorted human cells from bone marrow and spleen of representative RNP-HSC transplant recipients. Total gene editing frequency by DNA sequencing analysis and the types of editing events detected in human cells that were enriched from the spleen and bone marrow of mice transplanted with RNP treated human CD34+ cells 4 months prior. The gene editing frequency that was detected in the pre-infusion (ex vivo) cell product prior to transplantation and gene editing frequency detected in vivo in representative transplant recipients are shown.

Figure 24A:
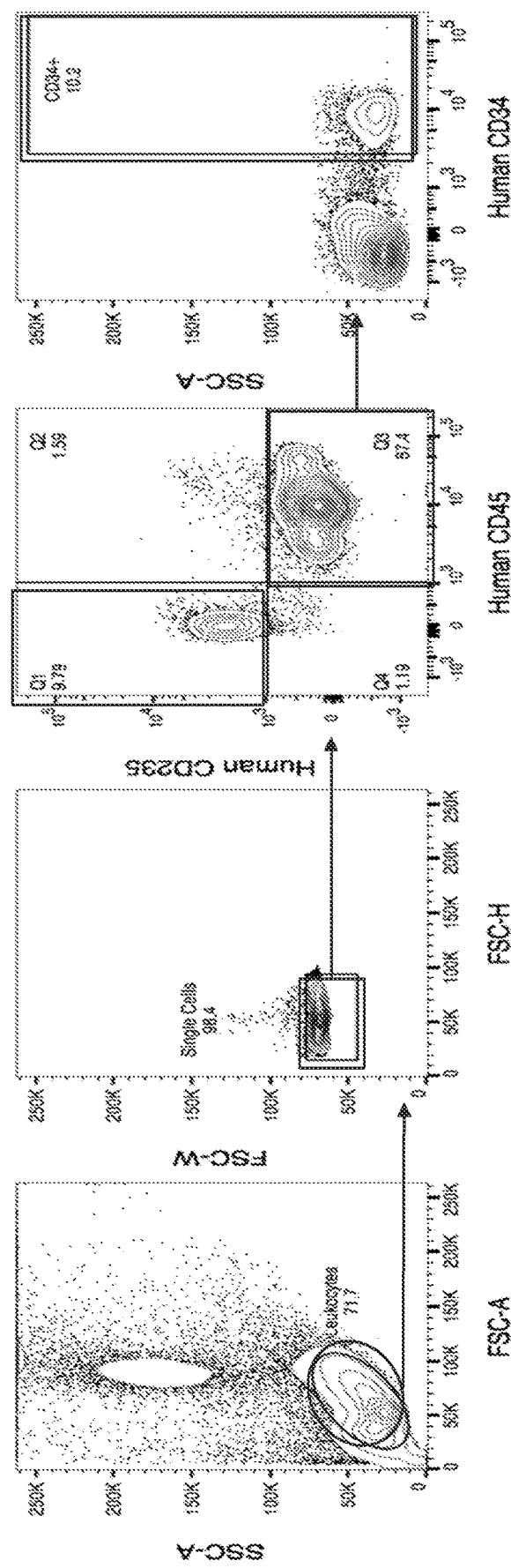

FIG. 24A shows flow cytometry data for repopulation of the mouse bone marrow with human CD34+ HSCs, human myeloid (CD33+), and human erythroid (CD235+) cells 4 months after transplantation with RNP treated human CD34+ cells.

Figure 24B:
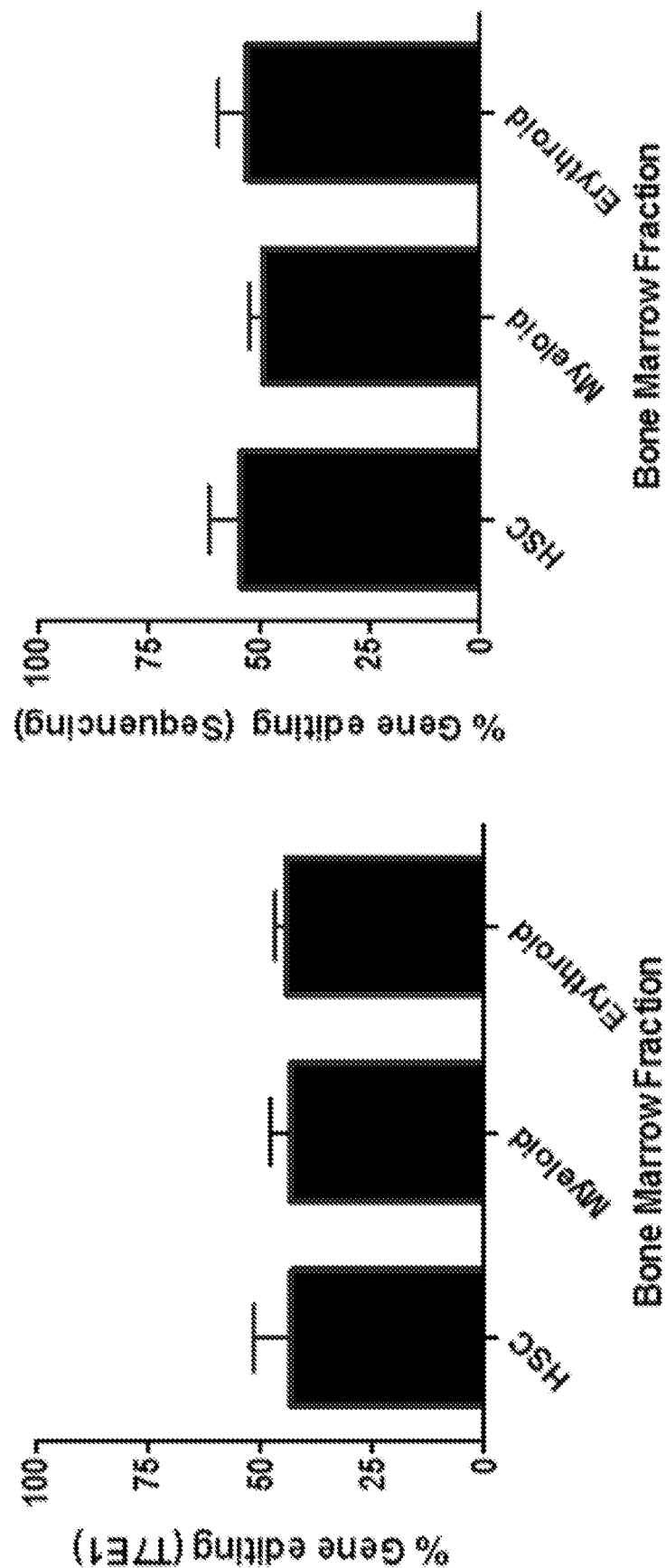

FIG. 24B shows the gene editing frequency detected in sorted human CD34+ HSCs, human CD33+ myeloid cells, and human erythroid CD235+ cells that were enriched from the bone marrow of transplanted mice, as determined by T7E1 analysis (left panel) and DNA sequencing (right panel).

Figure 25A:
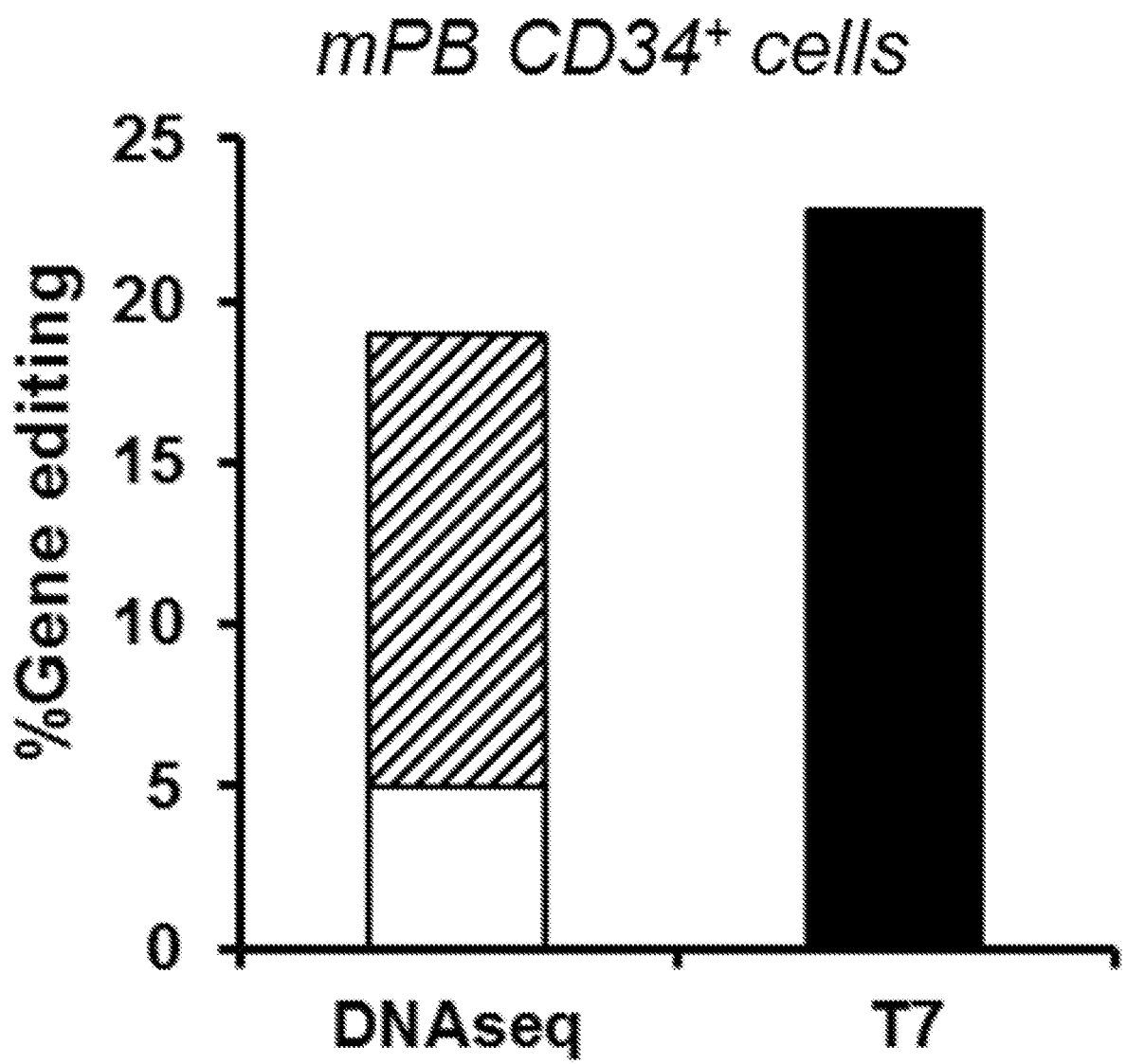

FIG. 25A depicts gene editing frequency in human adult mobilized peripheral blood (mPB) CD34+ cells as determined by T7E1 endonuclease analysis and DNA sequencing analysis.

Figure 25B:
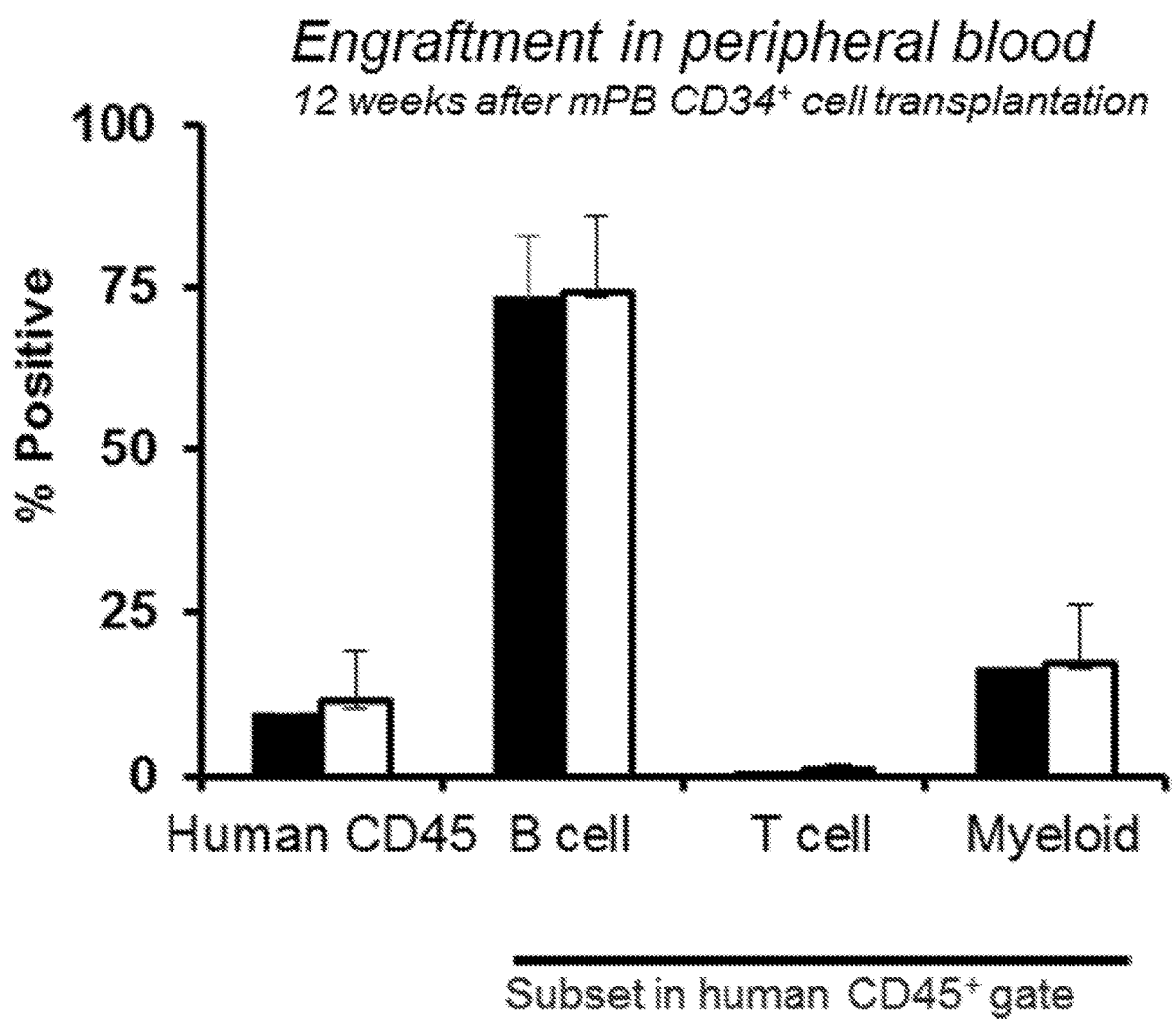

FIG. 25B depicts short-term engraftment of human CD45+ cell lymphoid and myeloid cells differentiated from RNP treated mPB CD34+ cells or untreated control mPB CD34+ cells in vivo 12 weeks after transplantation.

Figure 25C:
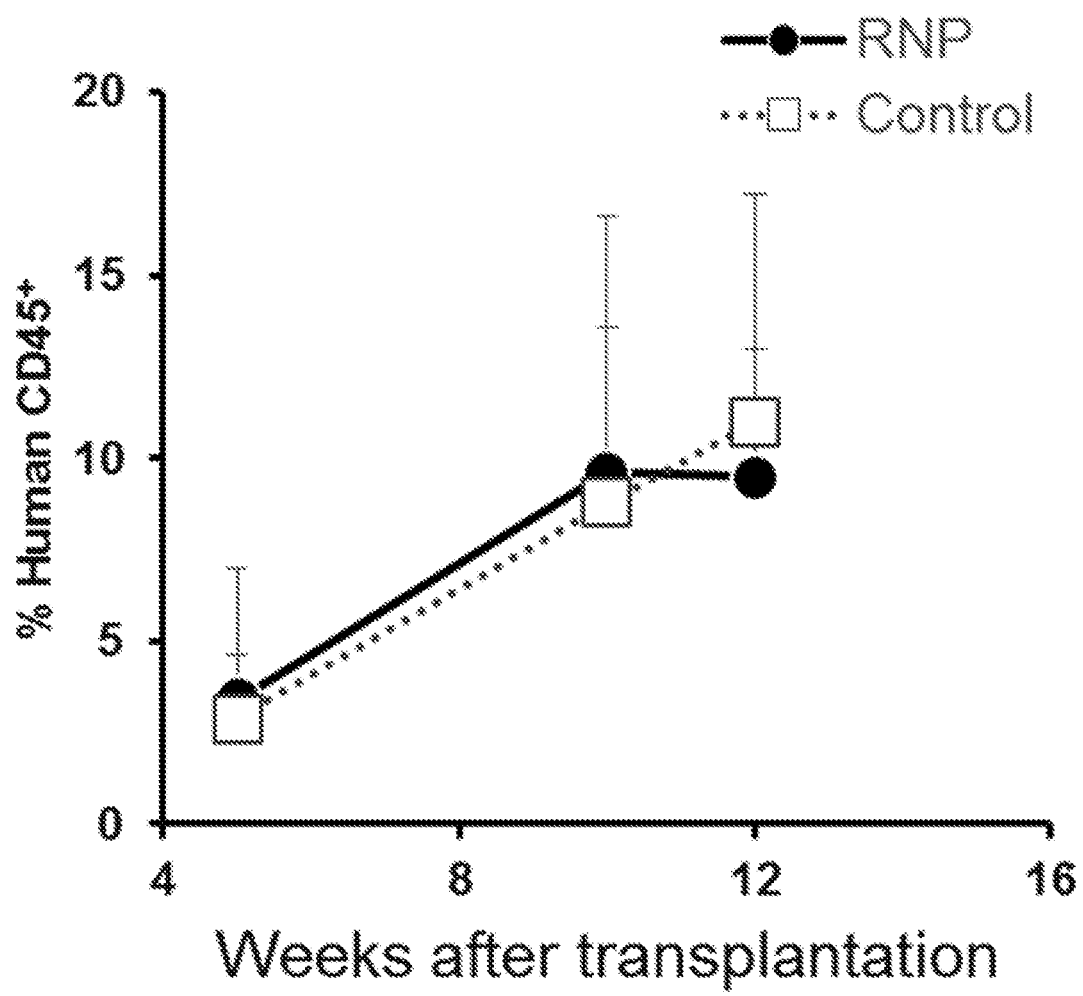

FIG. 25C depicts the kinetics of human CD45+ cell hematopoietic reconstitution with gene edited mPB CD34+ cells.

Figure 25D:
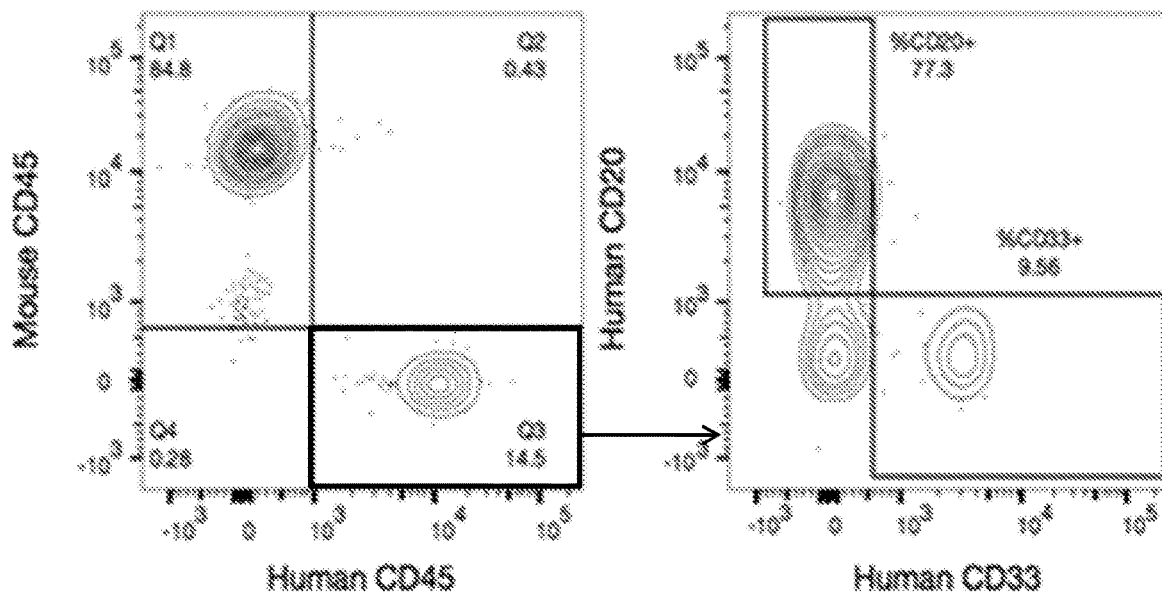
Figure 25D:
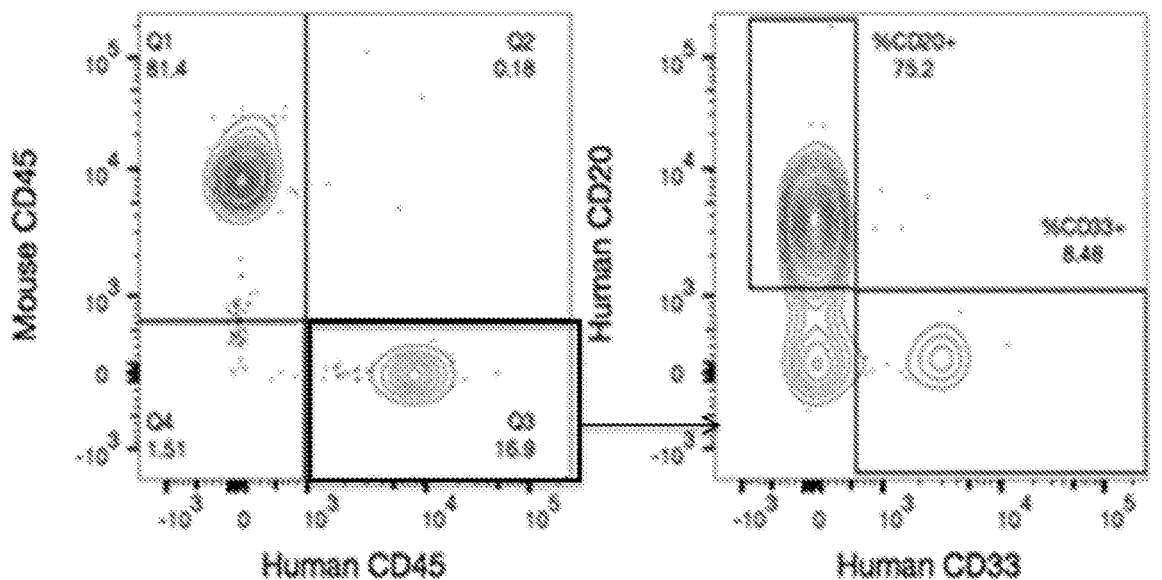

FIG. 25D shows representative flow cytometry analysis of peripheral blood from mice transplanted with RNP treated or untreated control human mPB CD34+ cells 12 weeks prior.

Figure 26A:
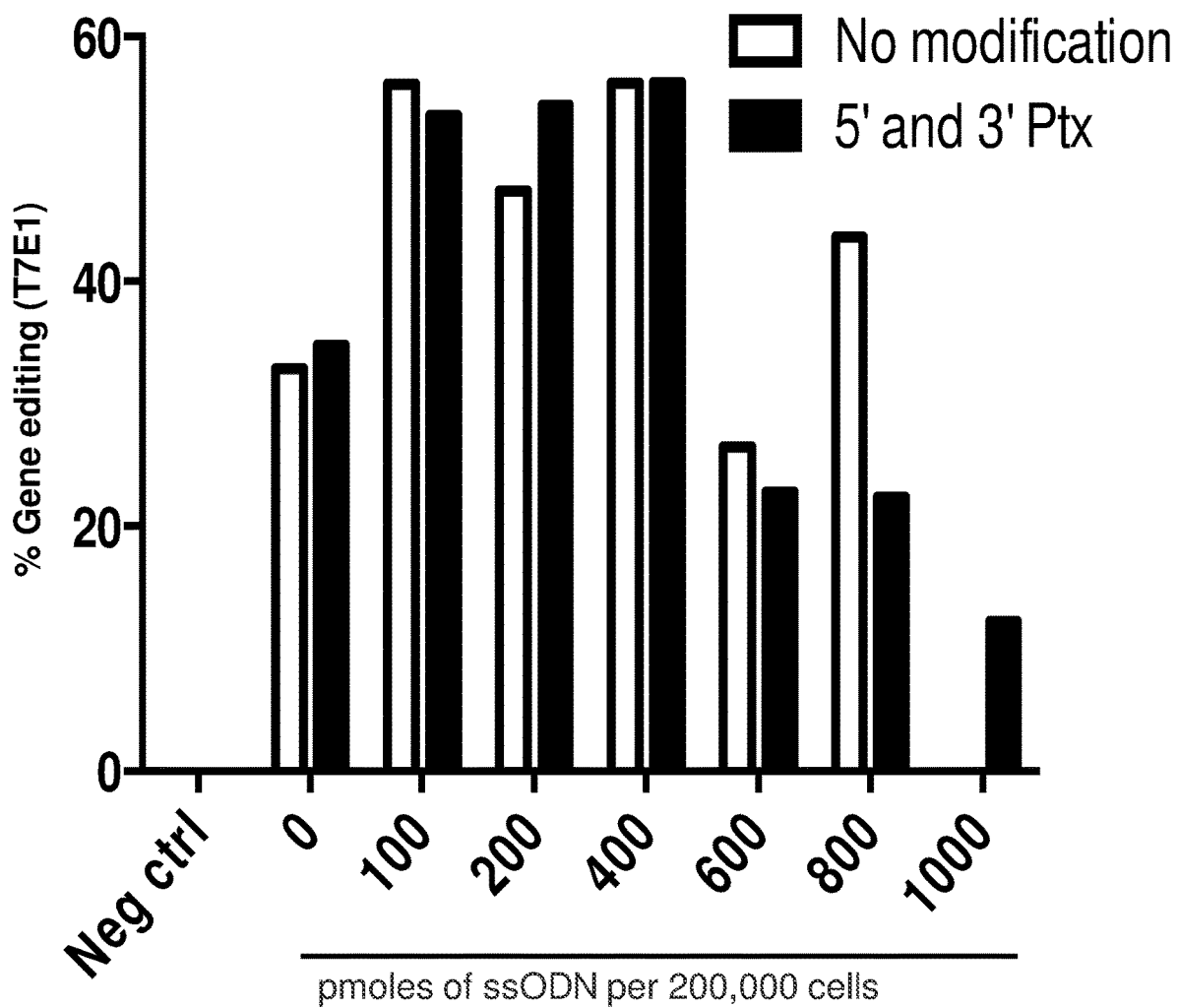
Figure 26B:
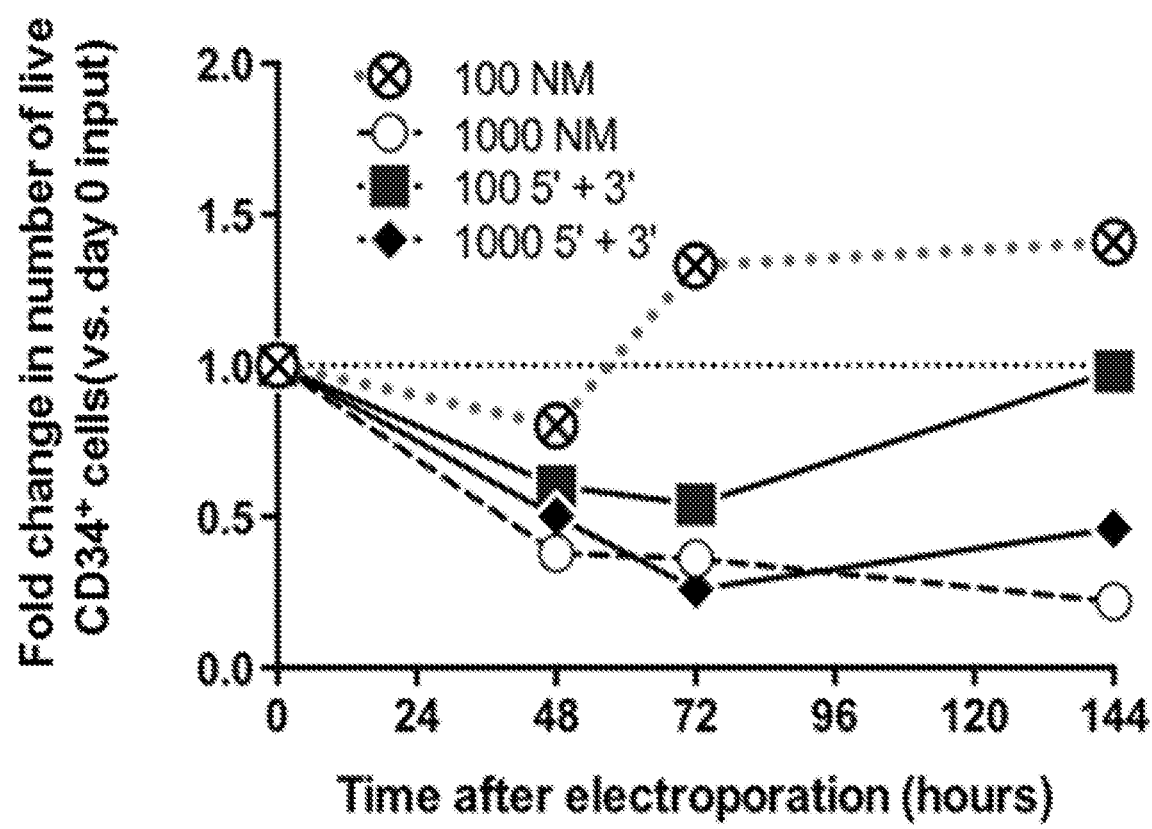
Figure 26C:
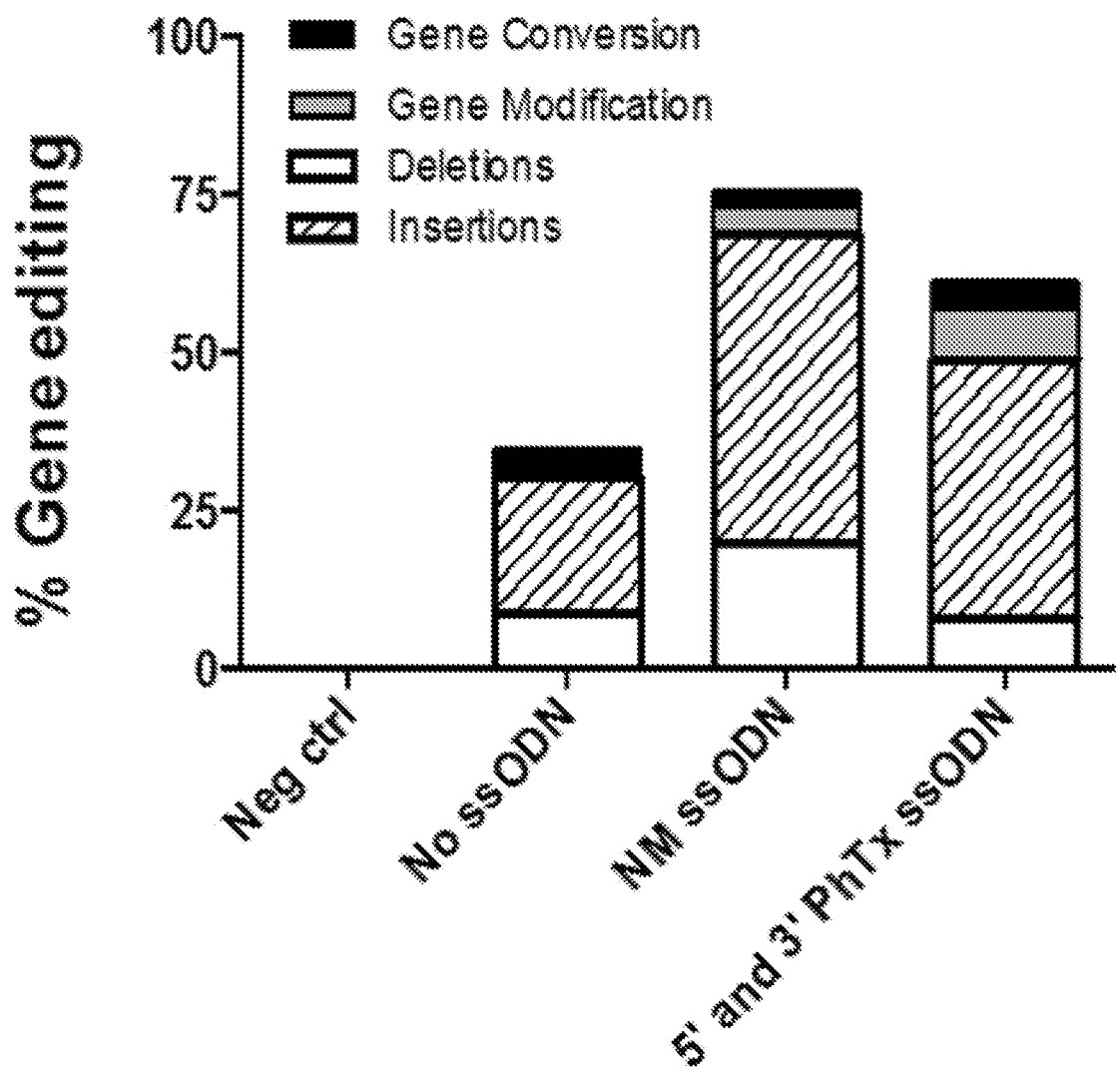
Figure 26D:
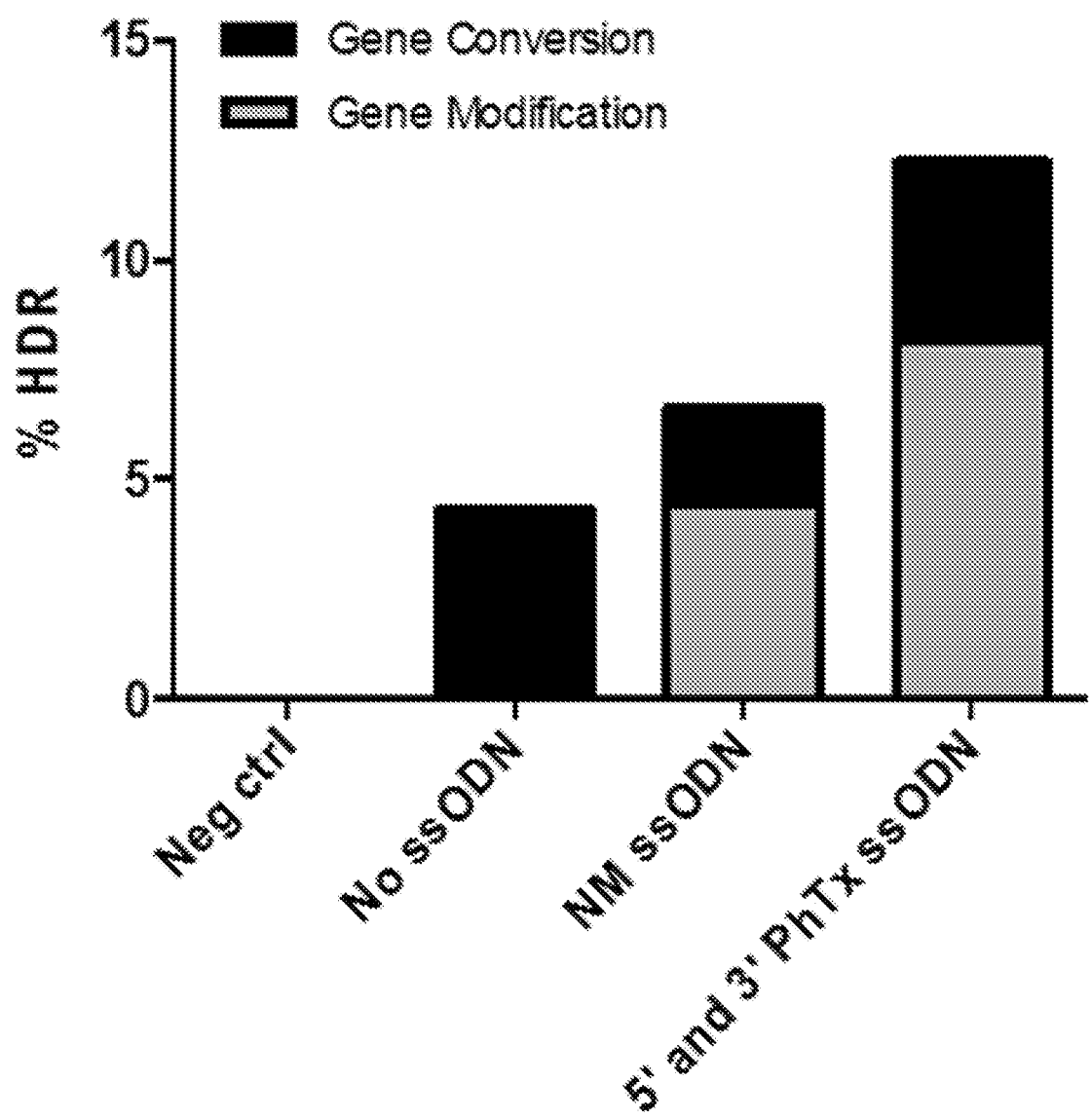

FIGS. 26A-26D depict gene editing frequency and homology directed repair frequency in human CB CD34+ cells after electroporation of D10A Cas9 RNP complexed to HBB-8 and HBB-15 gRNAs with or without co-delivery of a single strand oligonucleotide donor (ssODN) which had unmodified 5' and 3' ends (NM) or was modified with 1 phosphorothioate group at both the 5' and 3' end (Phx). FIG. 26A shows gene editing frequency (as determined by T7E1 endonuclease assay) in CB CD34+ cells after delivery of different quantities of ssODNs. FIG. 26B shows viability as measured by fold change in the number of human CD34+ cells over time relative to the time of electroporation with Cas9 D10A RNP and 2 gRNAs (HBB-8 (SEQ ID NO:388)

and HBB-15 (SEQ ID NO:387)) plus high and low quantities of unmodified and modified ssODNs. FIG. 26C depicts total and subsets of gene editing types as determined by DNA sequencing analysis. Not that gene modification indicates detection of the ssODN sequence at the target site (HDR). FIG. 26D shows total HDR frequency (i.e., the sum of gene conversion and gene modification) achieved with or without co-delivery of ssODN in CB CD34$^+$ cells.

Figure 27A:
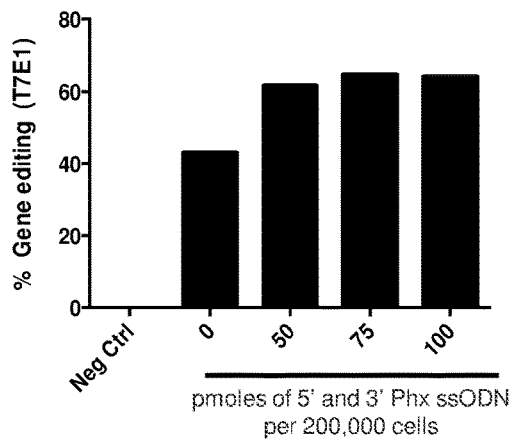
Figure 27B:
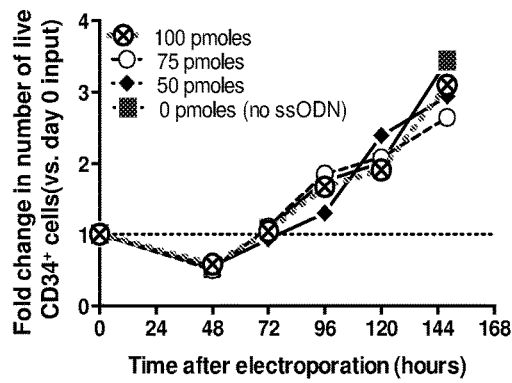
Figure 27C:
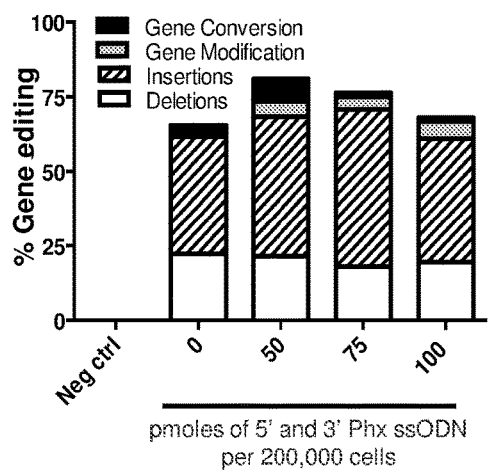
Figure 27D:
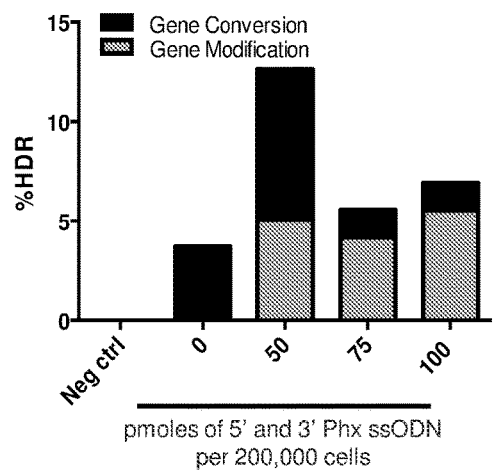
Figure 27E:
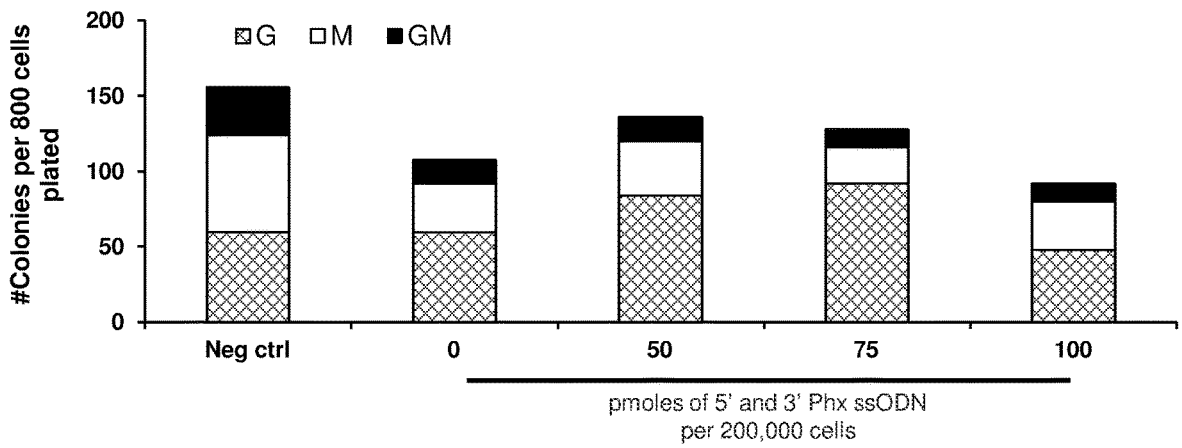

FIGS. 27A-27E show gene editing frequency and HDR frequency after co-delivery of D10A Cas9 RNP and 2 gRNAs (gRNAs HBB-8 (SEQ ID NO:388) and HBB-15 (SEQ ID NO:387)) with or without Phx ssODN titrated down below 100 pmoles per 200,000 cells. FIGS. 27A and 27B depict the frequency of gene editing events as determined by DNA sequencing analysis of the HBB locus-specific PCR product. FIG. 27C shows ex vivo differentiation potential or hematopoietic activity (i.e. colony forming potential) in untreated control and CD34$^+$ cells electroporated with D10A RNP and 2 gRNAs (2 gRNAs HBB-8 (SEQ ID NO:388) and HBB-15 (SEQ ID NO:387)) with or without ssODN. FIG. 27D depicts the frequency of HDR events, as determined by DNA sequence analysis, of cells treated with or without 0, 50, 75, 100 pmoles Phx-modified ssODN donor template. FIG. 27E shows ex vivo differentiation potential or hematopoietic activity (i.e. colony forming potential) in untreated control and CD34$^+$ cells electroporated with D10A RNP 2 gRNAs (HBB-8 and HBB-15) with or without ssODN. CFCs: colony forming cells, M: macrophage colony, GM: granulocyte-macrophage colony, G: granulocyte colony.

Figure 28:
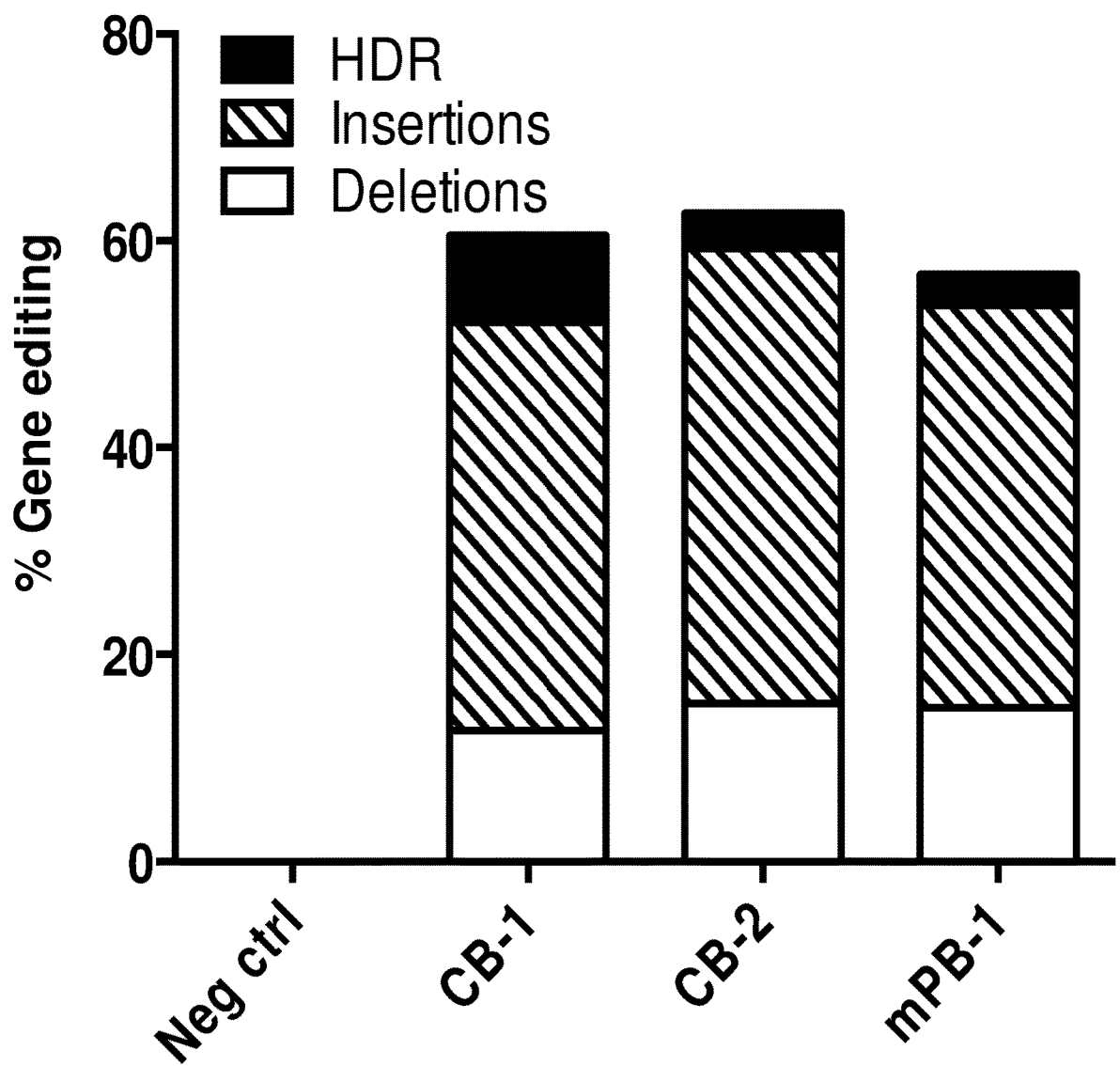

FIG. 28 shows total gene editing frequency and the frequency of types of gene editing events (as detected by DNA sequencing analysis) in 2 additional CB CD34$^+$ cell donors and one adult mPB CD34$^+$ cell donor after electroporation of D10A RNP complexed to HBB-8 and HBB-15 gRNAs, and 100 pmoles of Phx modified ssODN per 200,000 cells.

Figure 29A:
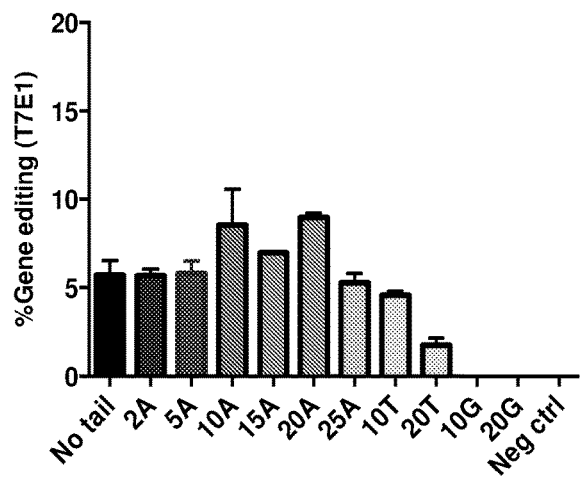
Figure 29B:
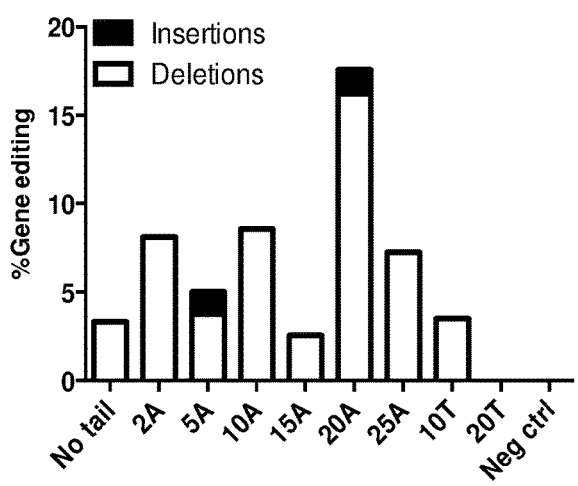

FIGS. 29A and 29B depict the effect of inclusion of a 5' end modification (e.g., ARCA cap) with or without a 3' end modification (e.g., poly(A) tail, poly(T) tail, or poly(G) tail of the specified length) on gRNAs on the gene editing frequency in, and hematopoietic potential (e.g., CFC) of, adult mPB CD34$^+$ cells. In the experiment depicted in FIG. 29A, gRNAs HBB-8 (SEQ ID NO:388) and HBB-15 (SEQ ID NO:387) were in vitro transcribed with the indicated 5' and 3' end modifications, complexed to D10A Cas9 protein. FIG. 29B gene editing frequency was determined by DNA sequencing analysis.

Figure 29C:
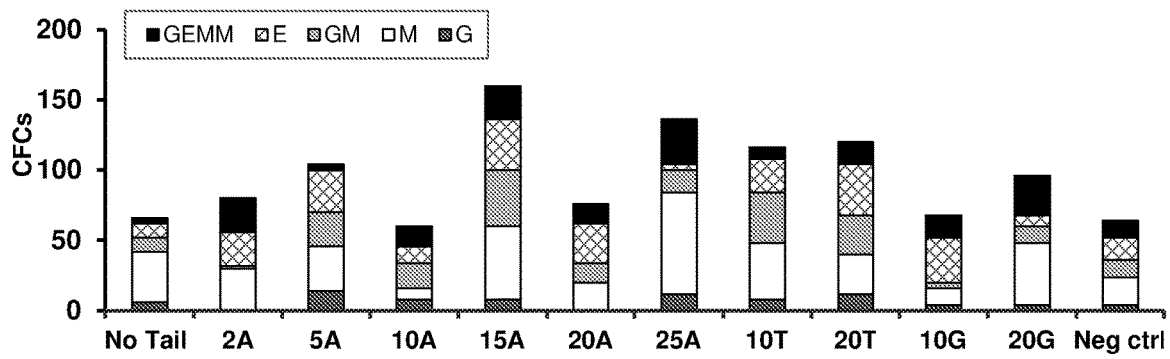

FIG. 29C depicts CFC potential of CB CD34$^+$ cells after electroporation with D10A Cas9 RNP targeting HBB locus using a dual nickase strategy, in which HBB-8 and HBB-15 gRNAs are both modified at 5' and/or 3' end with tein indicated modifications. E: erythroid, G: granulocyte, M: macrophage, GM: granulocyte-macrophage, GEMM: granulocyte-erythrocyte-macrophage-monocyte.

Figure 30A:
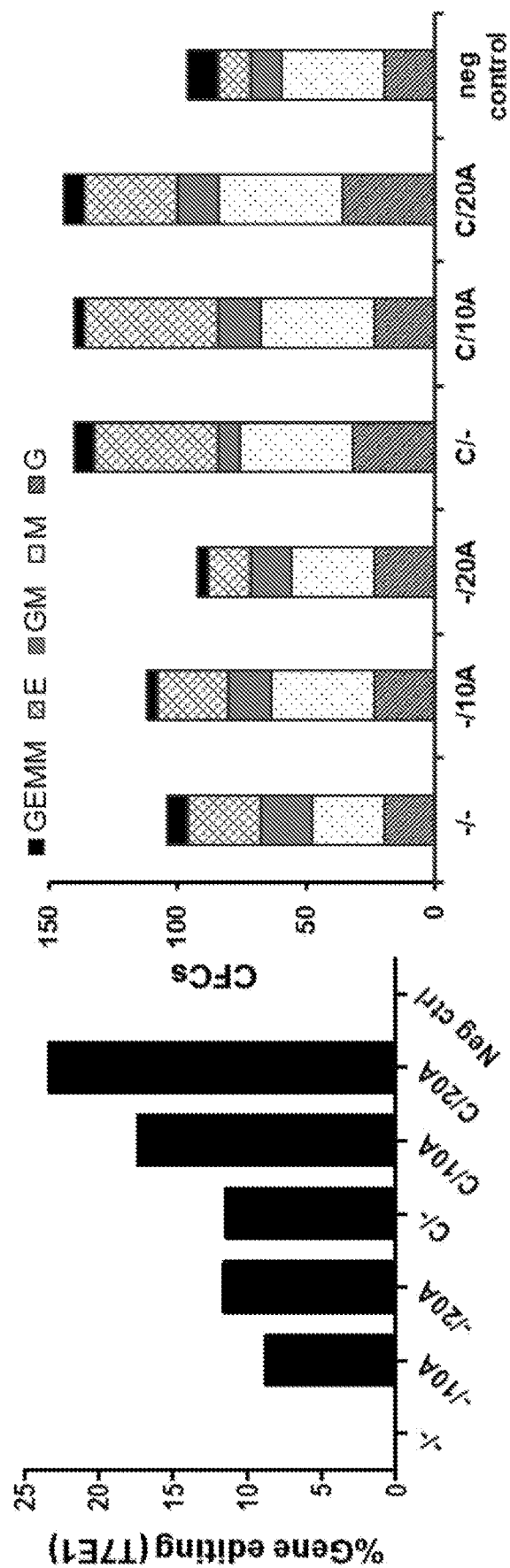
Figure 30B:
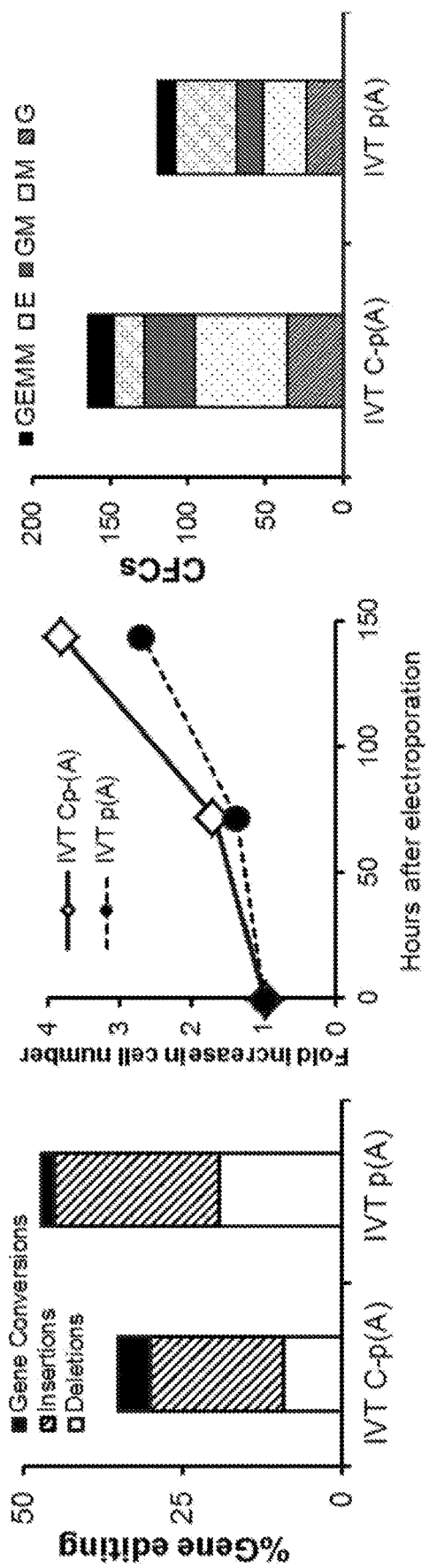
Figure 30C:
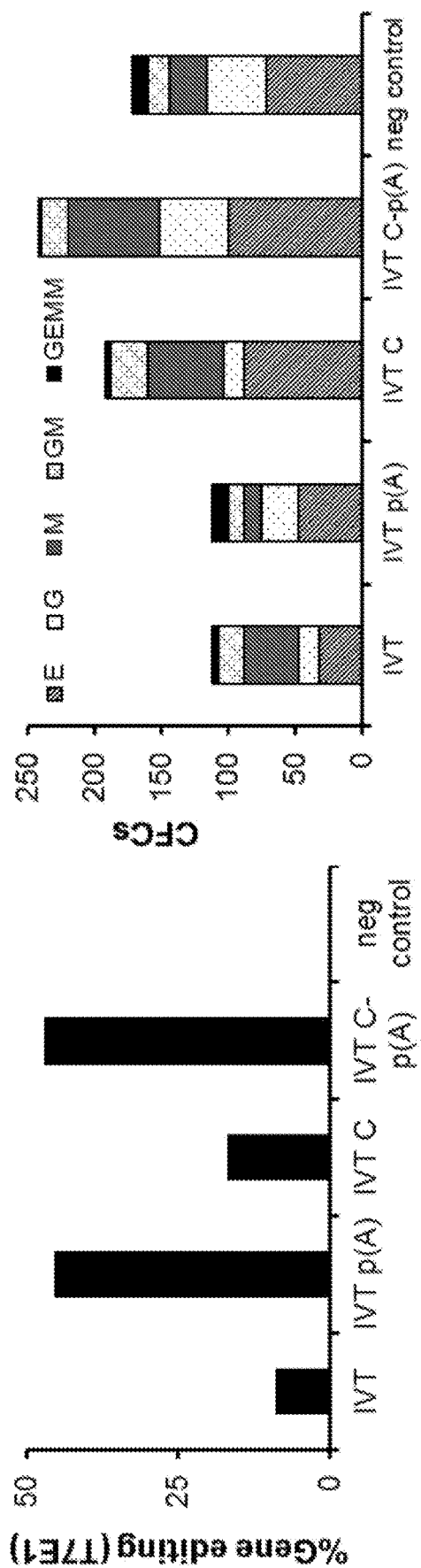

FIGS. 30A, 30B, and 30C depict gene editing frequency and CFC potential of CB CD34+ cells after electroporation with D10A Cas9 RNP targeting HBB locus using a dual nickase strategy, in which 2 gRNAs HBB-8 (SEQ ID NO:388) and HBB-15 (SEQ ID NO:387) are both modified at 5' and with the indicated 3' end modifications. E: erythroid, G: granulocyte, M: macrophage, GM: granulocyte-macrophage, GEMM: granulocyte-erythrocyte-macrophage-monocyte.

DETAILED DESCRIPTION

The methods and compositions described herein increase CRISPR/Cas9-mediated gene editing in stem cells, e.g., HSCs. Exposing stem cells to foreign molecules, such as a CRISPR/Cas9 system component (e.g., a gRNA molecule, Cas9 molecule, and/or a template nucleic acid) stresses the stem cell and induces an innate immune response that triggers, for example, programmed cell death or stem cell differentiation. The use of the methods and systems described herein reduces or abrogates the stress response and innate immune response signaling events that ultimately may lead to programmed cell death or stem cell differentiation in stem cells after exposure to foreign CRISPR/Cas9 components. Specifically, by transiently (e.g., for a period of less than 120 hours) exposing stem cells to a stem cell viability enhancer prior to and/or after contacting then stem cells with one or more CRISPR/Cas9 components, an innate immune response in the stem cell to the foreign CRISPR/Cas9 components is decreased, or prevented, thereby dramatically increasing the viability of the stem cell. Additionally, the acute and transient treatment of stem cells with stem cell viability enhancers (e.g., small molecules) also results in increased multipotency and self-renewal capability of the stem cell. Furthermore, the methods and compositions disclosed herein also result in increased engraftment of the stem cell in a target tissue upon introduction of the modified stem cell into a subject.

The unforeseen benefits of transiently exposing stem cells to the stem cell viability agents disclosed herein is surprising, given that they were typically used as stem cell expansion agents, e.g., to increase proliferation and the number of stem cells by several fold, e.g., at least 5-fold, and in view of the fact that the benefits for expansion of the stem cells required contact with the agents for a prolonged period of time (e.g., exposure for more than a week in cell culture). For example, in order demonstrate a significant increase in the number of stem cells in culture Boitono et al. cultured stem cells in the presence of SR1 for 3 weeks (see Boitano et al. 2010), and Gu et al. demonstrated that stem cells cultured with SR1 for 7 days lost lymphoid reconstitution potential compared to untreated cells, indicating that SR1 was not effective for viable stem cell expansion. This loss of multipotency of stem cells was also observed in Carlin et al. (*Cytotherapy,* 2013), where a 14-day co-culture of stem cells with other AhR antagonists (AhRA and dimethoxyflavone (DMF)) led to a loss of ex vivo lymphoid differentiation potential.

Thus, the methods and compositions described herein optimize the editing of a target nucleic acid sequence, resulting in a viable stem cell, and are particularly advantageous to advance the field of stem cell therapy in a multitude of clinical applications.

Definitions

As used herein, the term "viability' refers to the ability of a stem cell to live, maintain itself, and/or recover its potentialities, e.g., after exposure to a CRISPR/Cas9 system. In one embodiment, a viable stem cell is capable of being maintained in cell culture.

As used herein, the term "expand" or "expansion" refers to culturing stem cells (e.g., a CD34$^+$ HSC cell) for a period of time of at least 168 hours (e.g., 7 days) and under conditions which result an increase in the number of cells that is greater than 5-fold the initial cell number by the end of the period of time of at least 168 hours (e.g., 7 days).

As used herein, the term "maintenance," "maintain," "maintaining," or "maintained," when used in reference to cells in a culture, refers to culturing cells for a period of time and under conditions that support the viability of the cells, but wherein the cells increase in number by less than 5-fold, as compared to the initial cell number, during the period of time, or by the end of the period of time. In one embodiment, the cells increase in number by less than 4-fold the initial cell number. In one embodiment, the cells increase in number by less than 3-fold the initial cell number. In one embodiment, the cells increase in number by less than 2-fold the initial cell number. In one embodiment, the cells increase in number by less than 1.6-fold the initial cell number. In one embodiment, the fold change in the number of cells is greater than 1-fold but less than 2-fold the initial cell number. In another embodiment, the period of time is less than about 72 hours. In one embodiment, the period of time is less than about 48 hours. In another embodiment, the period of time is less than about 24 hours. For example, in one embodiment, the term maintenance refers to culturing stem cells for a period of about 72 hours under conditions wherein the cells increase in number by less than 5-fold during the period of about 96 hours, or by the end of the period of about 72 hours. In another embodiment, the term maintenance refers to culturing stem cells for a period of about 72 hours under conditions wherein the cells increase in number by less than 4-fold during the period of about 72 hours, or by the end of the period of 72 hours.

As used herein, the term "cell viability enhancer" or "stem cell viability enhancer" refers to a compound (e.g., a nucleotide, a protein, or a small molecule) which is capable of increasing the viability of a stem cell following exposure (e.g., electroporation) with a CRISPR/Cas9 system (e.g., a Cas9 system described herein), as compared to the viability of a stem cell of the same type following exposure with a Cas9 system in the absence of treatment with a stem cell viability enhancer. In some embodiments, the stem cell viability enhancer is a protein. In some embodiment, the stem cell viability enhancer is a peptide. In some embodiments, the stem cell viability enhancer is a small molecule. In some embodiments, the stem cell viability enhancer is a nucleic acid (e.g., an siRNA, shRNA, mRNA, DNA, RNA). In some embodiments, the stem cell viability enhancer is cell membrane permeable. In some embodiments, the stem cell viability enhancer is not cell membrane permeable. In some embodiments, the stem cell viability enhancer is nuclear membrane permeable. In some embodiment, the stem cell viability enhancer is not nuclear membrane permeable. In some embodiments, the stem cell viability enhancer is an aryl hydrocarbon receptor antagonist. In some embodiments, the stem cell viability enhancer is a pyrimidoindole derivative. In some embodiments, the stem cell viability enhancer is an innate immune response antagonist. In one embodiment, the stem cell viability enhancer is MG132. In another embodiment, the stem cell viability enhancer is SB431542. In another embodiment, the stem cell viability enhancer is UM171. In another embodiment, the stem cell viability enhancer is UM729. In another embodiment, the stem cell viability enhancer is 16,16-dimethyl prostaglandin E2 (dmPGE2).

As used herein, the term "innate immune response agonist" refers to a molecule which inhibits an innate immune response of the stem cell (e.g., in response to contact (e.g., via electroporation) of a stem cell with one or more components of a Cas9 system). In some embodiments, the stem cell viability enhancer inhibits a signaling event required for an innate immune response of the stem cell to occur (e.g., in response to contact (e.g., via electroporation) of the stem cell with one or more components of a Cas9 system). In some embodiments, the stem cell enhancers inhibits cell death (e.g., programmed cell death) of the stem cell. In some embodiments, the stem cell viability enhancer inhibits programmed cell death of the stem cell (e.g., in response to contact of the stem cell to one or more components of a Cas9 system). In some embodiments, the stem cell viability enhancer inhibits a signaling event required for a programmed cell death signaling event to occur in the cell (e.g., in response to contact of the stem cell to one or more components of a Cas9 system). In some embodiments, the stem cell viability enhancer inhibits senescence in the stem cell. In some embodiments, the stem cell viability enhancer inhibits differentiation of the stem cell. In one embodiment, the stem cell viability enhancer inhibits apoptosis of the stem cell. In one embodiment, the stem cell viability enhancer inhibits autophagy of the stem cell. In some embodiments, the stem cell viability enhancer increases the frequency of implantation of the stem cell into a target tissue, as compared to the frequency of implantation of a stem cell into a target tissue in the absence of treatment with the stem cell viability enhancer.

Examples of innate immune response antagonists are well known in the art. For example, in one embodiment, an innate immune response antagonist is cyclosporine A. In another embodiment, an innate immune response antagonist is dexamethasone. In another embodiment, an innate immune response antagonist is resveratrol. In another embodiment, an innate immune response antagonist is a MyD88 inhibitory peptide. In another embodiment, an innate immune response antagonist is an RNAi agent targeting MyD88. In another embodiment, an innate immune response antagonist is a B18R recombinant protein. In another embodiment, an innate immune response antagonist is glucocorticoid. In another embodiment, an innate immune response antagonist is OxPAPC. In another embodiment, an innate immune response antagonist is a TLR antagonist. In another embodiment, an innate immune response antagonist is rapamycin. In another embodiment, an innate immune response antagonist is BX795. In another embodiment, an innate immune response antagonist is a RLR inhibitor.

As used herein, the term "aryl hydrocarbon receptor antagonist" refers to a molecule which inhibits the activity of an aryl hydrocarbon receptor. Such molecules are known in the art. In one embodiment, the AhR antagonist is StemRegenin-1 (SR1), also known as 4-[2-[[2-benzo[b]thien-3-yl-9-(1-methylethyl)-9H-purin-6-yl]amino]ethyl]-phenol. In another embodiment, the AhR antagonist is AhRA. In another embodiment, the AhR antagonist is dimethoxyflavote. In another embodiment, the AhR antagonist is 6,2',4'-trimethoxyflavone. In another embodiment, the Ahr antagonist is LGC0006. In another embodiment, the AhR antagonist is alpha-napthoflavone. In yet another embodiment, the AhR antagonist is CH-223191.

As used herein, the term "transplanting" and "transplantation" refers to the process of transferring cells (e.g., the modified stem cells described herein) into and/or onto a host subject. In one embodiment, transplantation includes introducing the stem cells into the bloodstream or bone marrow of a patient. In another embodiment, transplantation includes introduction of the stem cells into a solid tissue or tumor of a patient. In some embodiments, following transplantation, the transferred cells engraft into a tissue of interest.

The term "engraft" as used herein refers to the process of incorporating a cell into a target tissue through contact with the tissue. As used herein, the term "target tissue" refers to any collection of similar cells and the extracellular substances surrounding them. In some embodiments, the target tissue includes, but is not limited to the epithelium, connective tissues (e.g., blood, bone and cartilage), muscle tissue and nerve tissue. In some embodiments, the target tissue includes, but is not limited to, peripheral blood, bone marrow, blood vessel, spleen, heart, liver, kidney, and skin.

As used herein, the terms "differentiate" and "differentiation" as used in describing a cellular process, refer to the acquisition or possession of one or more characteristics or functions different from those of the cell prior to transplantation. In some embodiments, the term "differentiation" includes the developmental process of lineage commitment. A "lineage" refers to a pathway of cellular development, in which a precursor or "progenitor" cell undergoes progressive physiological changes to become a specified cell type having a characteristic function (e.g., a nerve cell, a muscle cell, an immune cell, or an endothelial cell). Differentiation typically occurs in stages, whereby the primitive stem cell passes through several stages in which it loses the ability to self-renew and to give rise to many types of cells and gradually becomes more specified until it reaches full maturity, which is also referred to as "terminal differentiation." A "terminally differentiated cell" is a cell that has committed to a specific lineage, and has reached the end stage of differentiation (i.e., a cell that has fully matured).

As used herein, "progenitor cell" refers to a lineage cell that is derived from stem cell and retains mitotic capacity and multipotency (e.g., can differentiate or develop into more than one but not all types of mature lineage of cell).

As used herein "hematopoiesis" or "haemopoiesis" refers to the formation and development of various types of blood cells (e.g., red blood cells, megakaryocytes, myeloid cells (e.g., monocytes, macrophages and neutrophil), and lymphocytes) and other formed elements in the body (e.g., in the bone marrow).

As used herein, the term "CRISPR/Cas9 system," "CRISPR/Cas9 system," or "Cas9 system," refers to a system capable of altering a target nucleic acid by one of many DNA repair pathways. In certain embodiments, the Cas9 system described herein promotes repair of a target nucleic acid via an HDR pathway. In some embodiments, a Cas9 system comprises a gRNA molecule and a Cas9 molecule. In some embodiments, a Cas9 system further comprises a second gRNA molecule. In yet another embodiment, a Cas9 system comprises a gRNA molecule, a Cas9 molecule, and a second gRNA molecule. In some embodiments, a Cas9 system comprises a gRNA molecule, two Cas9 molecules, and a second gRNA molecule. In some embodiments, a Cas9 system comprises a first gRNA molecule, a second gRNA molecule, a first Cas9 molecule, and a second Cas9 molecule. In exemplary embodiments, a Cas9 system further comprises a template nucleic acid, e.g., a single stranded oligonucleotide. In one embodiment, a "gene editing system" or "stem cell gene editing system" is a kit comprising the components of a CRISPR/Cas9 system.

A "Cas9 molecule," as used herein, refers to a Cas9 polypeptide or a nucleic acid encoding a Cas9 polypeptide. A "Cas9 polypeptide" is a polypeptide that can interact with a gRNA molecule and, in concert with the gRNA molecule, localize to a site comprising a target domain and, in certain embodiments, a PAM sequence. Cas9 molecules include both naturally occurring Cas9 molecules and Cas9 molecules and engineered, altered, or modified Cas9 molecules or Cas9 polypeptides that differ, e.g., by at least one amino acid residue, from a reference sequence, e.g., the most similar naturally occurring Cas9 molecule. (The terms altered, engineered or modified, as used in this context, refer merely to a difference from a reference or naturally occurring sequence, and impose no specific process or origin limitations.) A Cas9 molecule may be a Cas9 polypeptide or a nucleic acid encoding a Cas9 polypeptide. A Cas9 molecule may be a nuclease (an enzyme that cleaves both strands of a double-stranded nucleic acid), a nickase (an enzyme that cleaves one strand of a double-stranded nucleic acid), or an enzymatically inactive (or dead) Cas9 molecule. A Cas9 molecule having nuclease or nickase activity is referred to as an "enzymatically active Cas9 molecule" (an "eaCas9" molecule). A Cas9 molecule lacking the ability to cleave target nucleic acid is referred to as an "enzymatically inactive Cas9 molecule" (an "eiCas9" molecule).

As used herein, the term "gRNA molecule" or "gRNA" refers to a guide RNA which is capable of targeting a Cas9 molecule to a target nucleic acid. In one embodiment, the term "gRNA molecule" refers to a guide ribonucleic acid. In another embodiment, the term "gRNA molecule" refers to a nucleic acid encoding a gRNA. In one embodiment, a gRNA molecule is non-naturally occurring. In one embodiment, a gRNA molecule is a synthetic gRNA molecule.

"Modified gRNA molecule" or "modified gRNA", as used herein, refers to a gRNA molecule that has an improved half life after being introduced into a cell as compared to a non-modified gRNA molecule after being introduced into a cell. In one embodiment, the modified gRNA molecule does not activate an innate immune response in a cell upon the cell being exposed (e.g., electroporated) to the gRNA molecule. In one embodiment, the modified gRNA molecule activates a reduced innate immune response in a cell upon the cell being exposed to the gRNA molecule, as compared to the innate immune response in the same type of cell upon the cell bing exposed to an unmodified gRNA molecule. In another embodiment, the modified gRNA molecule does not activate a programmed cell death pathway (e.g., an apoptotic cell death pathway, a necrosis cell death pathway (e.g., a necroptosis cell death pathway), an autophagic cell death pathway, an aponecrosis cell death pathway, a ferroptosis cell death pathway, an eryptosis cell death pathway, an aponecrosis cell death pathway, or an anoikis cell death pathway) in a cell upon the cell being exposed to the gRNA molecule. In some embodiments, the modified gRNA molecule does not activate a caspase-dependent cell death pathway. In another embodiment, the modified gRNA molecule does not activate a caspase-independent cell death pathway.

In one embodiment, a modified gRNA molecule comprises a 5'-end modification. In one embodiment, the 5'-end modification is a selected from the group consisting of: a G(5')ppp(5')G cap analog, a m7G(5')ppp(5')G cap analog, or a 3'-O-Me-m7G(5')ppp(5')G anti reverse cap analog (ARCA). In one embodiment, the 5'-end modification is a phosphorothioate modification. In one embodiment, the gRNA molecule comprises a 3'-end modification. In one embodiment, the 3'-end modification is a poly adenine tail. In one embodiment, the 3'-end modification is a phosphorothioate modification.

A "template nucleic acid," as the term is used herein, refers to a nucleic acid sequence which can be used in conjunction with a Cas9 molecule and a gRNA molecule to alter the structure of a target position. In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is RNA, e.g., double stranded RNA or single stranded RNA. In an embodiment, the template nucleic acid is encoded on the same vector backbone, e.g., AAV genome, plasmid DNA, as the Cas9 and gRNA. In an embodiment, the template nucleic acid is excised from a vector backbone in vivo, e.g., it is flanked by gRNA recognition sequences. In one embodiment, the template DNA is in an ILDV. In one embodiment, the template nucleic acid is an exogenous nucleic acid sequence. In another embodiment, the template nucleic acid sequence is an endogenous nucleic acid sequence, e.g., an endogenhous homologous region. In one embodiment, the template nucleic acid is a single stranded oligonucleotide corresponding to a plus strand of a nucleic acid sequence. In another embodiment, the template nucleic acid is a single stranded oligonucleotide corresponding to a minus strand of a nucleic acid sequence.

"Modified template nucleic acid," as used herein, refers to a template nucleic acid, e.g., single stranded oligonucleotide molecule which serves as a template, that has an improved half life after being introduced into a cell as compared to a non-modified template nucleic acid after being introduced into a cell. In one embodiment, the modified template nucleic acid does not activate an innate immune response in a cell upon the cell being exposed (e.g., electroporated) to the modified nucleic acid. In one embodiment, the modified template nucleic acid activates a reduced innate immune response in a cell upon the cell being exposed to the gRNA molecule, as compared to the innate immune response in the same type of cell upon the cell bing exposed to an unmodified template nucleic acid. In another embodiment, the modified template nucleic acid does not activate a programmed cell death pathway (e.g., an apoptotic cell death pathway, a necrosis cell death pathway (e.g., a necroptosis cell death pathway), an autophagic cell death pathway, an aponecrosis cell death pathway, a ferroptosis cell death pathway, an eryptosis cell death pathway, an aponecrosis cell death pathway, or an anoikis cell death pathway) in a cell upon the cell being exposed to the modified template nucleic acid. In some embodiments, the modified template nucleic acid does not activate a caspase-dependent cell death pathway. In another embodiment, the modified template nucleic acid does not activate a caspase-independent cell death pathway.

In one embodiment, the modified template nucleic acid is a single stranded oligodeoxynucleotide (ssODN). In one embodiment, the ssODN comprises a 5' phosphorothionate modification. In one embodiment, the ssODN comprises a 3' phosphorothionate modification. In one embodiment, the ssODN comprises a 5' phosphorothionate modification and a 3' phosphorothionate modification.

"Target mutant position", as used herein, refers to a target position in a gene, e.g., a gene described herein, which, if mutated, can result in a mutant protein and give rise to a disease, e.g., a disease described herein.

"Target knockout position", as used herein, refers to a position in a gene, e.g., a gene described herein, which if altered, results in alleviation of a symptom of disease, or a disease described herein.

"Target knockdown position", as used herein, refers to a position in a gene, e.g., a gene described herein, which if targeted, e.g., by a Cas9 molecule described herein, results in reduction or elimination of expression of functional gene product.

"Target knockin position", as used herein, refers to a sequence, which if modified by the insertion of a sequence of a gene, e.g., a gene described herein, results in an optimization of gene activity, e.g., by resulting in a gene sequence that encodes a protein having wild type activity.

"Target position", as used herein, refers to any of a target mutant position, a target knockout position, a target knockdown position, or a target knockin position, as described herein.

"HDR", or "homology-directed repair," as used herein, refers to the process of repairing DNA damage using a homologous nucleic acid (e.g., an endogenous homologous sequence, e.g., a sister chromatid, or an exogenous nucleic acid, e.g., a template nucleic acid). Canonical HDR typically acts when there has been significant resection at the double strand break, forming at least one single stranded portion of DNA. In a normal cell, HDR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

"Alt-HDR" or "alternative HDR", or alternative homology-directed repair, as used herein, refers to the process of repairing DNA damage using a homologous nucleic acid (e.g., an endogenous homologous sequence, e.g., a sister chromatid, or an exogenous nucleic acid, e.g., a template nucleic acid). Alt-HDR is distinct from canonical HDR in that the process utilizes different pathways from canonical HDR, and can be inhibited by the canonical HDR mediators, RAD51 and BRCA2. Also, alt-HDR uses a single-stranded or nicked homologous nucleic acid for repair of the break.

Unless indicated otherwise, the term "HDR" as used herein encompasses HDR and alt-HDR.

"Gene conversion", as used herein, refers to the process of repairing DNA damage by homology directed recombination (HDR) using an endogenous nucleic acid, e.g., a sister chromatid or a plasmid, as a template nucleic acid. Without being bound by theory, in some embodiments, BRCA1, BRCA2 and/or RAD51 are believed to be involved in gene conversion. In some embodiments, the endogenous nucleic acid is a nucleic acid sequence having homology, e.g., significant homology, with a fragment of DNA proximal to the site of the DNA lesion or mutation. In some embodiments, the template is not an exogenous nucleic acid.

"Gene correction", as used herein, refers to the process of repairing DNA damage by homology directed recombination using an exogenous nucleic acid, e.g., a donor template nucleic acid. In some embodiments, the exogenous nucleic acid is single-stranded. In some embodiments, the exogenous nucleic acid is double-stranded.

"Gene modification", as used herein, refers to the process of editing a nucleic acid using a CRISPR/Cas9 system described herein. In certain embodiments, the gene modification includes gene correction. In certain embodiments, gene modification includes gene conversion.

"Non-homologous end joining" or "NHEJ", as used herein, refers to ligation mediated repair and/or non-template mediated repair including canonical NHEJ (cNHEJ), alternative NHEJ (altNHEJ), microhomology-mediated end joining (MMEJ), single-strand annealing (SSA), and synthesis-dependent microhomology-mediated end joining (SD-MMEJ).

"Domain", as used herein, is used to describe segments of a protein or nucleic acid. Unless otherwise indicated, a domain is not required to have any specific functional property.

"Modulator", as used herein, refers to an entity, e.g., a drug, that can alter the activity (e.g., enzymatic activity, transcriptional activity, or translational activity), amount, distribution, or structure of a subject molecule or genetic sequence. In one embodiment, modulation comprises cleavage, e.g., breaking of a covalent or non-covalent bond, or the forming of a covalent or non-covalent bond, e.g., the attachment of a moiety, to the subject molecule. In one embodiment, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

A "polypeptide", as used herein, refers to a polymer of amino acids having less than 100 amino acid residues. In one embodiment, it has less than 50, 20, or 10 amino acid residues.

A "reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of *S. pyogenes, S. aureus* or *S. thermophilus*. In one embodiment, the reference Cas9 molecule is the naturally occurring Cas9 molecule having the closest sequence identity or homology with the Cas9 molecule to which it is being compared. In one embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In one embodiment, the subject is a human. In another embodiment, the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"Prevent", "preventing" and "prevention", as used herein, means the prevention of a disease in a mammal, e.g., in a human, including (a) avoiding or precluding the disease; (2) affecting the predisposition toward the disease, e.g., preventing at least one symptom of the disease or to delay onset of at least one symptom of the disease.

"X" as used herein in the context of an amino acid sequence, refers to any amino acid (e.g., any of the twenty natural amino acids) unless otherwise specified.

I. Optimization of Stem Cells

The stem cells, e.g., stem cells, described herein can be optimized or manipulated, e.g., ex vivo or in vivo. While not wishing to be bound by theory, it is believed that, in one embodiment, optimization or manipulation of stem cells allows for maintenance, persistence, or regulation of the cells for CRISPR/Cas-mediated gene editing or regulation. For example, optimization or manipulation of the stem cells, e.g., hematopoietic stem/progenitor cells (HSCs), can preserve cell fitness, functionality, self-renewal, engraftment potential, or prevent cell death through, for example a cell death mechanism, including, for example, autophagy, apoptosis, necrosis, aponecrosis, ferroptosis, eryptosis, anoikis, or cell senescence.

In certain embodiments, and while not wishing to be bound by theory, it is believed that contacting the cells with a stem cell viability enhancer desirably promotes cell fitness, functionality, self-renewal, engraftment potential, or prevents cell death. Stem cell viability enhancers are described in more detail below. For example, contacting a cell with a CRISPR/Cas9 component, e.g., a Cas9 molecule, a gRNA molecule, or both, and optionally, a template nucleic acid, may trigger one or more cellular events (e.g., a signaling event) resulting in programmed cell death and/or an innate immune response in the stem cell. Thus, by contacting the stem cell with a stem cell viability enhancer as described herein, the stem cell may more readily be manipulated using a CRISPR/Cas9 system.

The stem cells can be optimized or manipulated before, during, or after contact with a CRISPR/Cas9 component, e.g., a Cas9 molecule, a gRNA molecule, or both, and optionally, a donor template nucleic acid. In one embodiment, the stem cell is optimized or manipulated before contact with a CRISPR/Cas9 component. In one embodiment, the stem cell is optimized or manipulated during contact with a CRISPR/Cas9 component. In one embodiment, the stem cell is optimize or manipulated after contact with a CRISPR/Cas9 component. In one embodiment, the stem cell is optimized or manipulated before and during contact with a CRISPR/Cas9 component. In one embodiment, the stem cell is optimized or manipulated during and after contact with a CRISPR/Cas9 component. In one embodiment, the stem cell is optimized or manipulated before and after contact with a CRISPR/Cas9 component. In one embodiment, the stem cell is optimized or manipulated before, during, and after contact with a CRISPR/Cas9 component.

Several different optimization or manipulation steps can be applied in sequence, e.g., at specific time intervals relative to contact with a CRISPR/Cas9 component, e.g., a Cas9 molecule, a gRNA molecule, or both, and optionally a donor template nucleic acid. Several different optimization or manipulation steps can also be applied simultaneously, e.g., at a specific time interval relative to contact with a CRISPR/Cas9 component, e.g., a Cas9 molecule, a gRNA molecule, or both, and optionally a donor template nucleic acid.

For example, the stem cells can be optimized or manipulated by contacting with one or more stem cell viability enhancers (e.g., a cell agonist). As another example, the stem cells can be optimized or manipulated to contain one or more transgenes. The transgene can be integrated into a specific locus in the genome of the stem cell, e.g., by a CRISPR/Cas9 related mechanism. In one embodiment, transgenes can provide a safety switch that would allow for regulation of the enrichment and/or purification of modified cells before transplantation. It is also believed that, in one embodiment, transgenes would allow for expansion of modified cells in vivo if the engrafted cells are not well-detected, or allow for removal of modified cells in vivo in the event that the modified cells are dysfunctional or undergo leukemic transformation. As yet another example, the stem cells can be optimized or manipulated by contacting with one or more eiCas9 molecules, e.g., fused to a transcriptional repressor or activator.

Stem Cell Viability Enhancers

The stem cells described herein can be contacted with one or more stem cell viability enhancers (e.g., an aryl hydrocarbon receptor (AhR) antagonist, an innate immune response antagonist, or other stem cell viability enhancere described herein), e.g., to promote cell survival and prevent cell death that may result in response to contacting the cell with a CRISPR/Cas9 component (e.g., in response to a signaling event triggered by a CRISPR/Cas9 component (e.g., an innate immune response) or a gene editing event).

In one embodiment, the stem cell viability enhancer is a AhR antagonist. In one embodiment, the stem cell viability enhancer is a pyrimido-[4,5-b]-indole derivative. In one embodiment, the stem cell viability enhancer is an innate immune response antagonist. In one embodiment, the stem cell viability enhancer is a prostaglandin E2. In one embodiment, the stem cell viability enhancer is a NFκB inhibitor. In one embodiment, the stem cell viability enhancer is a mTOR inhibitor. In one embodiment, the stem cell viability enhancer is a MyD88 inhibitors. In one embodiment, the stem cell viability enhancer is a TGF-β inhibitor. In one embodiment, the stem cell viability enhancer is a Toll-Like Receptor (TLR) inhibitor. In one embodiment, the stem cell viability enhancer is a an inhibitor of reactive nitrogen and oxygen species. In one embodiment, the stem cell viability enhancer is a proteosome inhibitor. In one embodiment, the stem cell viability enhancer is a histone acetyltransferase inhibitor. In one embodiment, the stem cell viability enhancer is a c-MPL agonist. In one embodiment, the stem cell viability enhancer is a Ndr kinase modulator.

Previously, some stem cell viability enhancers were shown to assist in expansion of stem cell populations. However, the methods described herein do not require contacting the stem cell for a period of time long enough to promote expansion of the stem cell. Rather, the methods described herein only require contacting the stem cell with the stem cell viability enhancer for a period of time sufficient to increase the viability of the stem cell, e.g., inhibit innate immune responses and/or innate immune responses, prior and/or after exposure to a CRISPR/Cas9 component.

For example, 1-120 hours before and up to 96 hours after contact with a CRISPR/Cas9 component (e.g., a Cas9 molecule, a gRNA molecule, or both, and optionally a donor template nucleic acid), the stem cells can be cultured in StemSpan SFEM containing SCF, TPO, FL and optionally one or more stem cell viability enhancers. To promote survival, after contact with the CRISPR/Cas9 component(s), the stem cells may be contacted with more of the following stem cell viability enhancers in order to promote survival and prevent cell death which may occur upon cell perturbation by exposure to exogenous or foreign/unfamiliar nucleic acid, protein, or viral particles which contain a CRISPR/Cas9 component. While not wishing to be bound by theory, acute pretreatment (e.g., before contact with a CRISPR/Cas9 component) and posttreatment (e.g., after contact with a CRISPR/Cas9 component) of stem cells with stem cell viability enhancer can promote survival and maintenance of stem cells, prevent senescence and death of stem cells (e.g., via a programmed cell death pathway).

In one embodiment, the stem cell is contacted with a stem cell viability enhancer before the stem cell is contacted with a CRISPR/Cas9 component. In one embodiment, the stem cell is contacted with a stem cell viability enhancer after the stem cell is contacted with a CRISPR/Cas9 component. In one embodiment, the target stem cell is contacted with a stem cell viability enhancer before the cell is contacted with a CRISPR/Cas9 component, and after the cell is contacted with a CRISPR/Cas9 component.

In one embodiment the stem cell is contacted with the stem cell viability enhancer for a period of fewer than 72 hours after the stem cell is contacted with a CRISPR/Cas9 component. In one embodiment, the period of fewer than 72 hours is about 48 hours. In one embodiment, the period of fewer than 72 hours is about 48±about 12 hours. In one embodiment, the period of fewer than 72 hours is about 24 hours. In one embodiment, the period of fewer than 72 hours is about 48 hours or less. In one embodiment, the period of fewer than 72 hours is about 24 hours or less. In certain embodiments, the stem cell is cryopreserved within about 48 hours of the end of the period of fewer than 72 hours. In certain embodiments, the stem cell is cryopreserved within about 24 hours of the end of the period of fewer than 72 hours. In certain embodiments, the stem cell is transferred into a subject (e.g., a human subject) within about 48 hours of the end of the period of fewer than 72 hours. In certain embodiments, the stem cell is transferred into a subject (e.g., a human subject) within about 24 hours of the end of the period of fewer than 72 hours.

In one embodiment, the stem cell is a hematopoietic stem/progenitor cell (HSC). In one embodiment the stem cell is a circulating blood cell. In one embodiment, the stem cell is a mobilized blood cell. In one embodiment, the stem cell is a bone marrow cell. In one embodiment, the stem cell is a myeloid progenitor cell. In one embodiment, the stem cell is a lymphoid progenitor cell. In one embodiment, the stem cell is a lymphoid progenitor cell. In one embodiment, the stem cell is a multipotent progenitor cell. In one embodiment, the stem cell is a lineage restricted progenitor cell. In one embodiment, the stem cell is an endothelial cell. In one embodiment, the stem cell is a mesenchymal stromal cell. In one embodiment, the stem cell is non-cord blood $CD34^+$ cell. In one embodiment, the stem cell is an umbilical cord endothelial cell or cord blood cell. In one embodiment, the stem cell is a cord blood $CD34^+$ cell.

In one embodiment, the stem cell is cultured in the presence of the cell viability enhancer (e.g., an aryl hydrocarbon receptor, an innate immune response antagonist, or other cell viability enhancer described herein) for 14, 13, 12, 11, 10, 9, 8, 7, 6, 5, or 4 days, or less, or for 96, 72, 60, 48, 36, 24, 12, 6, 3, 2, or 1 hours or less. In one embodiment, the stem cell is cultured in the presence of the stem cell viability enhancer for more than 0.5, 1, 2, 3, 4, 5, 6, 7, 8, 9, 10, 11, 12, 24, 36, 48, 60, 72, 84, or 96 hours. In one embodiment, the stem cell is cultured in the presence of a cell viability enhance for a period of fewer that 120 hours.

Aryl Hydrocarbon Receptor (AhR) Antagonists

In one embodiment, the stem cell viability enhancer is an aryl hydrocarbon receptor (AhR) antagonist. The aryl hydrocarbon receptor (AhR) is a transcription factor which mediates responses to environmental toxins such as 2,3,7,8-tetrachlorodibenzo-p-dioxin (TCDD or dioxin) and other polychlorinated biphenyls and is involved in stem cell proliferation and differentiation (see, e.g., Thurmond et al. (1999) *Toxicol. Appl. Pharmacol.* 158: 33-40; Singh et al. (2009) *Biochem. Pharmacol.* 77, 577-587; Esser (2012) *Arch. Toxicol.* 86: 1323-1329). Multiple AhR antagonists have been identified to date.

Exemplary AhR antagonists for use as disclosed herein include, but are not limited to, Stem Regenin 1 (Boitano et al. 2010), dimethoxyflavone (Carlin et al. 2013), 6,2',4'-trimethoxyflavone (CAS No. 720675-74-1; Murray et al. (2010) *J. Pharmacol. Exp. Ther.* 332(1): 135-44), CH 223191 (also known as 1-Methyl-N-[2-methyl-4-[2-(2-methylphenyl)diazenyl]phenyl-1H-pyrazole-5-carboxamide; CAS No. 301326-22-7), alpha-naphthoflavone (ANF or α-NF), LGC006 (Boitano et al. 2010); 1-amino-3,7,8-trichlorodibenzo-p-dioxin (Luster et al. (1986) *Biochem Biophys Res Commun.* 139: 747-56), 3'methoxy-4'-nitroflavone (Henry et al. (1999) *Mol. Pharmacol.* 55: 716-25), resveratrol (Ciolino et al. (1998) *Cancer Res.* 58: 5707-12), and GNF-351 (also known as N-(2-(1H-Indol-3-yl)ethyl)-9-isopropyl-2-(5-methylpyridin-3-yl)-9H-purin-6-amine; see, e.g., Smith et al. (2011) *J. Pharmacol. Exp. Ther.* 338: 318-27). Other AhR antagonists, including analogs of the AhR antagonist disclosed herein, are known to those of skill in the art.

In one embodiment, the AhR antagonist is StemRegenin-1 (SR1). SR1 is a small molecule (4-[2-[[2-benzo[b]thien-3-yl-9-(1-methylethyl)-9H-purin-6-yl]amino]ethyl]-phenol) that was identified in a screen for molecules that support HSC expansion (Boitano et al., 2010, *Science* 329:1345-1348).

In certain embodiments, the stem cell is contacted with one AhR antagonists. In certain embodiments, the stem cell is contacted with two or more AhR antagonists. In certain embodiments, the stem cell is contacted with one or more AhR antagonists before the cell is contacted with a CRISPR/Cas9 component. In certain embodiments, the stem cell is contacted with one or more AhR antagonists before and after the cell is contacted with a CRISPR/Cas9 component. In some embodiments, the stem cell is contacted with at least a first AhR antagonist before the cell is contacted with a CRISPR/Cas9 component and is further contacted with a second AhR antagonist after the cell is contacted with a CRISPR/Cas9 component. In some embodiments, said first and said second AhR antagonist are different AhR antagonists.

The proper concentration of AhR antagonist for use in the methods disclosed herein will be readily apparent to those of skill in the art (see, e.g., Merchant et al. (1990) *Arch. Biochem. Biophys.* 281: 84-9; and Gasiewicz et al. (1991) *Mol. Pharmacol.* 40: 607-12). In some embodiments, the stem cell is contacted with a medium comprising less than 5, 4, 3, 2, or 1 μM of AhR antagonist. In some embodiments, the stem cell is contacted with a medium comprising less than 900, 800 700, 600, 500, 400, 300, 200, 100, 50 nM of AhR antagonist. In some embodiments, the stem cell is contacted with a medium comprising 1500, 1400, 1300, 1200, 1100, 1000, 900, 800, 700, 600, 500, 400, 300, 200, 150, 100, 90, 80, 70, 60, 50, 40, 30, 20, or 10 nM of AhR antagonist. In some embodiments, the stem cell is contacted with a medium comprising at least 10, 20, 30, 40, 50, 60, 70, 80, 90, 100, 200, 250, 300, 400, 500 nM of AhR antagonist.

In some embodiments, the stem cell is contacted with a medium comprising both an AhR antagonist and a cytokine (e.g., a cytokine disclosed herein). In some embodiments, the stem cell is contacted with a medium comprising both an AhR antagonist and a pyrimidoindole derivative (e.g., UM729, UM171). For example, in one embodiment, the stem cell is contacted with SR1 and UM729. In another embodiment, the stem cell is contacted with SR1 and UM171.

Innate Immune Response Antagonists

In another embodiment, the stem cell viability enhancer is an innate immune response antagonist. As used herein, the term "innate immune response antagonist" refers to a molecule which inhibits an innate immune response of the stem cell (e.g., in response to contact (e.g., via electroporation) of a stem cell with one or more components of a Cas9 system). In some embodiments, the stem cell viability enhancer inhibits a signaling event required for an innate immune response of the stem cell to occur (e.g., in response to contact (e.g., via electroporation) of the stem cell with one or more components of a Cas9 system). In some embodiments, the stem cell enhancers inhibit cell death (e.g., programmed cell death) of the stem cell. In some embodiments, the stem cell viability enhancer inhibits programmed cell death of the stem cell (e.g., in response to contact of the stem cell to one or more components of a Cas9 system). In some embodiments, the stem cell viability enhancer inhibits a signaling event required for a programmed cell death signaling event to occur in the cell (e.g., in response to contact of the stem cell to one or more components of a Cas9 system). In some embodiments, the stem cell viability enhancer inhibits senescence in the stem cell. In some embodiments, the stem cell viability enhancer inhibits differentiation of the stem cell. In one embodiment, the stem cell viability enhancer inhibits apoptosis of the stem cell. In one embodiment, the stem cell viability enhancer inhibits autophagy of the stem cell. In some embodiments, the stem cell viability enhancer increases the frequency of implantation of the stem cell into a target tissue, as compared to the frequency of implantation of a stem cell into a target tissue in the absence of treatment with the stem cell viability enhancer.

Examples of innate immune response antagonists are well known in the art. Exemplary innate immune response antagonists for use as disclosed herein include, but are not limited to, cyclosporin A, TLR-4C34 (also know as 3,4,6-triacetate-1-methylethyl 2-(acetylamino)-2-deoxy-α-D-glucopyranoside; CAS No. 40592-88-9), CLI-095 (also known as TAK-242 or resatorvid), TLR-4 inhibitor peptide VIPER (see, e.g., Lysakova-Devine et al. (2010) *J Immunol.* 185: 4261-4271), resveratrol, nitric oxide, carbocysteine, CGS 25462, CHS 828, clarithromycin, dipyridamole, disulfiram, diltiazem, fenoldopam, fibrates, fluvastatin, gleevec, leflunomide, moxifloxacin, perindopril, raloxifene, rapamycin, ritonavir, tetrathiomolybdate, triflusal, troglitazone, a MyD88 inhibitory peptide, an RNAi agent targeting Myd88, a B18R recombinant protein, a glucocorticoid (e.g., dexamethasone), 1-palmitoyl-2-arachidonyl-sn-glycero-3-phosphorylcholine (OxPAPC), a TLR antagonist, rapamycin, bafilomycin, BX795, FK506 (tacrolimus) and a retinoic acid-inducible gene I-like receptors (RLR) inhibitor (e.g., a small molecule, or an inhibitory nucleic acid (i.e., shRNA or siRNA) that inhibits or reduces the expression of a RLR receptor described herein). In one embodiment, the innate immune response antagonist is cyclosporin A. In another embodiment, the innate immune response antagonist is dexamethasone. In one embodiment, the innate immune response antagonist is resveratrol. In another embodiment, the innate immune response antagonist is transforming growth factor-β (TGF-β) type I receptor activin receptor-like kinase ALK5 inhibitor SB431542 (also known as 4-[4-(1, 3-benzodioxol-5-yl)-5-(2-pyridinyl)-1H-imidazol-2-yl]benzamide; CAS No. 301836-41-9; see, e.g., Inman et al. Mol. Pharmacol. 62(1): 65-74). In one embodiment, the innate immune response antagonist is the protease inhibitor MG132 (also know as benzyl (S)-4-methyl-1-((S)-4-methyl-1-((S)-4-methyl-1-oxopentan-2-ylamino)-1-oxopentan-2-ylamino)-1-oxopentan-2-ylcarbamate; see, e.g., Tsubuki et al. (1996) *J. Biochem.* 119: 572-6). Without wishing to be bound by any theory, the use of a proteasome inhibitor may be particularly advantageous to prevent the degradation of a Cas9 molecule to which a stem cell is exposed. In another embodiment, the innate immune response antagonist is the MyD88 inhibitory peptide PepinH-MYD (NBP2-29328, Novus Biologicals). In another embodiment, the innate immune response antagonist is IMO-8400 (see, e.g., Suarez-Fariñas et al. (2013) *PLoS One* 8(12): e84634). In one embodiment, the innate immune response antagonist is a nucleic acid inhibitor of MyD88 (e.g., an shRNA, siRNA, antisense RNA that inhibits or reduces the expression of MyD88). In one embodiment, the innate immune response antagonist is a B18R protein (also known as vaccinia virus-encoded neutralizing type I interferon receptor or Type I IFN inhibitor; see, e.g., Vancová et al. (1998) *J. Gen. Virol.* 79 (Pt 7): 1647-9). In one embodiment, the innate immune response antagonist is a glucocorticoid (e.g., aldosterone, deoxycorticosterone acetate, fludrocortisone acetate, beclometasone, triamcinolone, betamethasone, dexamethasone, methylprednisolone, prednisolone, prednisone, cortisone and hydrocortisone). In some embodiments, the innate immune response antagonist is oxidized 1-palmitoyl-2-arachidonyl-sn-glycero-3-phosphorylcholine (OxPAPC). In one embodiment, the innate immune response antagonist is a nucleic acid inhibitor of a Toll-Like Receptor (TLR) (e.g., an shRNA, siRNA, antisense RNA that inhibits or reduces the expression of a TLR described herein). In another embodiment, the innate immune response antagonist is rapamycin. In one embodiment, the innate immune response antagonist is the mTOR inhibitor bafilomycin. In another embodiment, the innate immune response antagonist is N-[3-[[5-Iodo-4-[[3-[(2-thienylcarbonyl)amino]propyl]amino]-2-pyrimidinyl]amino]phenyl]-1-pyrrolidinecarboxamide (BX795; CAS No. 702675-74-9). In one embodiment, the innate immune response antagonist is a retinoic acid-inducible gene I-like (RIG-I-like) receptor (RLR) inhibitor. In one embodiment, the RIG-I-like receptor is a receptor encoded by a gene selected from the group consisting of RIG-I, MDA-5, LGP2, STING, DAK and RNF125. In one embodiment, the RIG-I-like receptor inhibitor is an inhibitor of the receptor encoded by the gene RIG-I (e.g., a small molecule, or an inhibitory nucleic acid (i.e., shRNA or siRNA) that inhibits or reduces the expression of a RIG-I). In another embodiment, the RIG-I-like receptor inhibitor is an inhibitor of the receptor encoded by the gene MDA-5 (e.g., a small molecule, or an inhibitory nucleic acid (i.e., shRNA or siRNA) that inhibits or reduces the expression of MDA-5). In another embodiment, the RIG-I-like receptor inhibitor is an inhibitor of the receptor encoded by the gene LGP2 (e.g., a small molecule, or an inhibitory nucleic acid (i.e., shRNA or siRNA) that inhibits or reduces the expression of LGP2). In another embodiment, the RIG-I-like receptor inhibitor is an inhibitor of the receptor encoded by the gene STING (e.g., a small molecule, or an inhibitory nucleic acid (i.e., shRNA or siRNA) that inhibits or reduces the expression of STING). In another embodiment, the RIG-I-like receptor inhibitor is an inhibitor of the receptor encoded by the gene SAK (e.g., a small molecule, or an inhibitory nucleic acid (i.e., shRNA or siRNA) that inhibits or reduces the expression of DAK). In another embodiment, the RIG-I-like receptor inhibitor is an inhibitor of the receptor encoded by the gene RNF125 (e.g., a small molecule, or an inhibitory nucleic acid (i.e., shRNA or siRNA) that inhibits or reduces the expression of RNF125). In one embodiment, the innate immune response antagonist is GW788388 (also known as 4-[4-[3-(2-Pyridinyl)-1H-pyrazol-4-yl]-2-pyridinyl]-N-(tetrahydro-2H-pyran-4-yl)-benzamide); CAS No. 452342-67-5). In one embodiment, the innate immune response antagonist is (also known as 4-[2-(6-methylpyridin-2-yl)-5,6-dihydro-4H-pyrrolo[1,2-b]pyrazol-3-yl]quinoline-6-carboxamide; 6-Quinolinecarboxamide, 4-[5,6-dihydro-2-(6-methyl-2-pyridinyl)-4H-pyrrolo[1,2-b]pyrazol-3-yl], LY-2157299; CAS No. 700874-72-2). In one embodiment, the innate immune response antagonist is Fresolumimab (also known as GC1008). In another embodiment, the innate immune response antagonist is TLR-4C34 (also know as 3,4,6-triacetate-1-methylethyl 2-(acetylamino)-2-deoxy-α-D-glucopyranoside; CAS No. 40592-88-9). In one embodiment, the innate immune response antagonist is CLI-095 (also known as TAK-242 or resatorvid). In another embodiment, the innate immune response antagonist is the TLR-4 inhibitor peptide VIPER.

In one embodiment, the innate immune response antagonist is resveratrol. In another embodiment, the innate immune response antagonist is nitric oxide. In one embodiment, the innate immune response antagonist is carbocysteine. In another embodiment, the innate immune response antagonist is CGS 25462.

In one embodiment, the innate immune response antagonist is CHS 828. In another embodiment, the innate immune response antagonist is clarithromycin. In one embodiment, the innate immune response antagonist is dipyridamole. In another embodiment, the innate immune response antagonist is disulfiram. In one embodiment, the innate immune response antagonist is diltiazem. In another embodiment, the innate immune response antagonist is fenoldopam. In one embodiment, the innate immune response antagonist is fibrates. In another embodiment, the innate immune response antagonist is fluvastatin. In one embodiment, the innate immune response antagonist is gleevec. In another embodiment, the innate immune response antagonist is leflunomide. In one embodiment, the innate immune response antagonist is perindopril. In another embodiment, the innate immune response antagonist is moxifloxacin. In one embodiment, the innate immune response antagonist is raloxifene. In another embodiment, the innate immune response antagonist is rapamycin. In one embodiment, the innate immune response antagonist is ritonavir. In another embodiment, the innate immune response antagonist is tetrathiomolybdate. In one embodiment, the innate immune response antagonist is triflusal. In another embodiment, the innate immune response antagonist is troglitazone. In one embodiment, the innate immune response antagonist is lovastatin. In another embodiment, the innate immune response antagonist is NR-101 (Nitino et al. (2009) Exp. Hematol. 37(11): 1364-77). In one embodiment, the innate immune response antagonist is mir-125a (see, e.g., Pan et al. (2015) *Nat. Commun.* 6: 7096). In one embodiment, the innate immune response antagonist is a Ndr kinase modulator.

In one embodiment, the innate immune response antagonist is an NFκB inhibitor (e.g., an NFκB disclosed in Table 1a). Without wishing to be bound by theory, NFκB inhibitors may be used to maintain the viability and/or decrease an innate immune response in a stem cell associated with exposure to a CRISPR/Cas9 component. In one embodiment, the NFκB inhibitor is dexamethasone. In another embodiment, the NFκB inhibitor is reservatrol. In one embodiment, the NFκB inhibitor is SB431542. In another embodiment, the NFκB inhibitor is MG132. In another embodiment, the NFκB inhibitor is carbocysteine. In one embodiment, the NFκB inhibitor is CGS 25462. In another embodiment, the NFκB inhibitor is CHS 828. In one embodiment, the NFκB inhibitor is clarithromycin. In another embodiment, the NFκB inhibitor is dipyridamole. In one embodiment, the NFκB inhibitor is disulfiram. In another embodiment, the NFκB inhibitor is diltiazem. In one embodiment, the NFκB inhibitor is fenoldopam. In another embodiment, the NFκB inhibitor is fibrates. In one embodiment, the NFκB inhibitor is fluvastatin. In another embodiment, the NFκB inhibitor is gleevec. In one embodiment, the NFκB inhibitor is leflunomide. In another embodiment, the NFκB inhibitor is moxifloxacin. IN one embodiment, the NFκB inhibitor is perindopril. In another embodiment, the NFκB inhibitor is raloxifene. In one embodiment, the NFκB inhibitor is rapamycin. In another embodiment, the NFκB inhibitor is ritonavir. In one embodiment, the NFκB inhibitor is tetrathiomolybdate. In another embodiment, the NFκB inhibitor is triflusal. In one embodiment, the NFκB inhibitor is troglitazone. In one embodiment, the NFκB is denosumab.

While not wishing to be bound by theory, it is believed that, In one embodiment, contacting a stem cell with an immunomodulatory compound described herein (e.g., an innate immune response antagonist) can regulate stem cell self-renewal, maintenance, and survival, e.g., by inhibiting a cellular innate immune response and subsequent cell senescence response induced by gene editing associated with DNA damage. In another embodiment, contacting a stem cell with an innate immune response antagonist described herein can inhibit the activation of programmed cell death of the stem cell induced by contacting the cell with a CRISPR/Cas9 component.

For example, inflammatory cytokines (e.g., interferon [IFN]), tumor necrosis factor alpha (TNFα) and toll-like receptors (TLR) can directly influence stem cells, e.g., HSCs, which allows for HSCs to support an effective immune response while maintaining hematopoiesis in the peripheral blood. For example, inflammatory cytokines can activate the HSCs in vivo to participate in the immune response by skewing differentiation toward myeloid or lymphoid progeny based on cellular events required to retard an invading pathogen (e.g., increased production of myeloid neutrophils as innate immune anti-bacterial effector cells, etc.). Accordingly, by contacting a stem cell with an innate immune response antagonist, programmed cell death (e.g., apoptosis) can be prevented. Exemplary innate immune response components and innate immune response antagonists are described in Table 1a. Additional innate immune response antagonists are shown in Table 1b.

TABLE 1a

| Pathway/Target | Examplary inhibitors |
| --- | --- |
| Calceneurin | cyclosporin A |
| NFκB | dexamethasone, reservatrol, SB431542, MG132, carbocysteine, CGS 25462, CHS 828, clarithromycin, dipyridamole, disulfiram, diltiazem, fenoldopam, fibrates, fluvastatin, gleevec, leflunomide, moxifloxacin, perindopril, raloxifene, rapamycin, ritonavir, tetrathiomolybdate, triflusal, troglitazone, denosumab |
| MyD88 | MyD88 inhibitory peptide, MyD88 RNAi agents |
| Interferon Type I (α, β), IRF3 and other IFN transcription factors | B18R recombinant protein |
| Interferon Type II (γ), IRF3 and other IFN transcription factors | glucocorticoids |
| Toll-like receptors | oxidized 1-palmitoyl-2-arachidonyl-sn-glycero-3-phosphorylcholine (OxPAPC), TLR shRNAs, TLR antagonists (e.g., oligodeoxynucleotides) |
| mTOR | Rapamycin; bafilomycin |
| RIG-I receptors | BX795, RLR inhibitory agents |

TABLE 1b

| Compound | Examples | Novel use on HSCs during gene editing |
| --- | --- | --- |
| AhR Antagonist | SR1, AhRA, DMP, 6,2',4'-6,2',4'-Trimethoxyflavone, CH223191 | Maintain viability |
| pyrimido-[4,5-b]-indole derivative | UM171, UM729 | Maintain viability |
| Prostaglandin E2 | (15S)-Prostaglandin e2 (dinoprostone) | Maintain viability |
| NFKB inhibitors | Denosumab FK506 cyclosporin A | Prevent innate immune response and cell death or differentiation from immune response |
| mTOR inhibitor, immunosuppressant | FK506, Cyclosporin A | Prevent innate immune response and cell death or differentiation from immune response |
| MyD88 inhibitors | IMO-8400 | Prevent innate immune response and cell death or differentiation from immune response |
| TGF-b inhibitors | SB431542, GW788388, galunisertib (LY2157299), Fresolumimab | Induce HSCs to leave quiescence dormancy for gene editing process |

TABLE 1b-continued

| Compound | Examples | Novel use on HSCs during gene editing |
|---|---|---|
| TLR inhibitors, including TLR2 inhibitors, TLR3 inhibitors, TLR4 inhibitors, TLR7 inhibitors, TLR9 inhibitors | OxPAPC, TLR4-C34, CLI-095, TAK-242 (Resatorvid), TLR-4 inhibitor peptide VIPER (NBP2-26244; Novus Biologicals) | Prevent innate immune response and cell death or differentiation from immune response |
| Inhibitors of Reactive Nitrogen and Oxgen Species | Lovastatin | Prevent stress and inflammation and cell death or differentiation from stress |
| Proteosome inhibitors | MG132 | Delay degradation of Cas9 protein to increase editing |
| Histone acetyltransferase inhibitors | Garcinol | Increase gene editing and maintain viability |
| c-MPL agonists | NR-101 (see, for example, Exp. Hematol., 2009, 37(11): 1364-1377) | Maintain viability |
| miRNA | mir-125a inhibitor | Maintain viability |
| Ndr kinase modulators | | Maintain viability |

Additionally, certain stem cells, e.g., HSCs, express TLR receptors including 4, 7, 8, and 9 (reviewed in Baldridge et al. (2011) *Trends Immunol.* 32(2): 57-65). TLR7/8 and TLR3 sense double stranded and single stranded ribonucleic acids, respectively, while TLR9 senses deoxyribonucleic acid. The retinoic acid inducible gene-like receptors (e.g., RIG-I) are RNA helicases that sense RNA and may induce an interferon response (reviewed by Kajaste-Rudnitski and Naldini (2015) *Human Gene Therapy* 26: 201-209). TLR signaling can lead to a proinflammatory response through NFκB signaling. Therefore, blocking any of these factors (e.g., including blocking interferon or transcription factors such as IRF3 to prevent interferon response) that are involved in the innate immune response in stem cells, e.g., HSCs, can prevent programmed cell death (e.g., apoptosis) of the stem cell induced, for example, by contact with a CRISPR/Cas9 component described herein. The clinically approved immunomodulatory compounds cyclosporine A (CsA) and FK506 (Tacrolimus), both of which are inhibitors of the $Ca^{2+}$-dependent phosphatase calcineurin, and rapamacin have also been used ex vivo to improve lentivirus mediated transduction by blocking innate cell immunity in HSCs (Petrillo et al. (2015) *Mol. Therapy* 23(2): 352-62). Inhibition of calcineurin activation prevents expression of pro-inflammatory cytokines. Rapamycin, a canonical inducer of autophagy via inhibition of the mammalian target of rapamycin (mTOR) complexes, has been shown to improve lentivirus transduction of HSCs without induction of autophagy or compromising cell engraftment (Wang et al. (2014) Blood 24: 9130923).

In one embodiment, the stem cell is contacted with an innate immune response inhibitor. In one embodiment, the immunomodulatory compound is a compound that modulates, e.g., inhibits a pathway or target described in Table 1a or Table 1b. The stem cell may be contacted with the immunomodulatory compound before, during, and/or after contact with a CRISPR/Cas9 component, e.g., a Cas 9 molecule, a gRNA molecule, or both, and optionally a donor template nucleic acid.

In certain embodiments, the stem cell is contacted with one innate immune response antagonist. In certain embodiments, the stem cell is contacted with two or more innate immune response antagonists. In certain embodiments, the stem cell is contacted with one or more innate immune response antagonists before the cell is contacted with a CRISPR/Cas9 component. In one embodiment, the stem cell is contacted with one or more innate immune response antagonists after the cell is contacted with a CRISPR/Cas9 component. In certain embodiments, the stem cell is contacted with one or more innate immune response antagonists before and after the cell is contacted with a CRISPR/Cas9 component.

In some embodiments, the stem cell is contacted with at least a first innate immune response antagonist before the cell is contacted with a CRISPR/Cas9 component and is further contacted with a second antagonist after the cell is contacted with a CRISPR/Cas9 component. In some embodiments, said first and said second innate immune response antagonists are different innate immune response antagonists. In another embodiment, the first and second innate immune response antagonists are the same innate immune response antagonist.

Other Stem Cell Viability Enhancers

In certain embodiments, the stem cell viability enhancer is selected from the group consisting of UM171, UM729 and 16, 16-dimethyl prostaglandin E2. In one embodiment, the stem cell viability enhancer is UM171 ((1r,4r)-N1-(2-benzyl-7-(2-methyl-2H-tetrazol-5-yl)-9H-pyrimido[4,5-b]indol-4-yl)cyclohexane-1,4-diamine; CAS No. 1448724-09-1; see, e.g., Fares et al. (2014) *Science* 345(6203): 1509-1512). In another embodiment, the stem cell viability enhancer is UM729 (methyl 4-((3-(piperidin-1-yl)propyl)amino)-9H-pyrimido[4,5-b]indole-7-carboxylate; CAS No. 1448723-60-1; see, e.g., Fares et al. (2014) *Science* 345(6203): 1509-1512). In yet another embodiment, the stem cell viability enhancer is 16, 16-dimethyl prostaglandin E2 (9-oxo-11α,15R-dihydroxy-16,16-dimethyl-prosta-5Z,13E-dien-1-oic acid; dmPGE2; CAS No. 39746-25-3). In one embodiment, the stem cell viability enhancer is prostaglandin E2 (PGE2). In another embodiment, the stem cell viability enhancer is MG132. In yet another embodiment, the stem cell viability enhancer is SB431542.

Cytokines

After obtaining, generating, and/or isolating stem cells, but before contacting the cell with a CRISPR/Cas9 component (e.g., a Cas9 molecule, a gRNA molecule, or both, and optionally a donor template nucleic acid), the stem cell can be cultured in a medium containing one or more cytokines, e.g., in addition to the stem cell viability enhancer. Additionally, after contacting the cell with a CRISPR/Cas9 component, the stem cell can be cultured in a medium containing one more more cytokines, e.g., in addition to the stem cell viability enhancer.

Without wishing to be bound by theory, culturing the cell in a medium which further comprises a cytokine disclosed herein may induce cell cycle entry of the cell. Exemplary cytokines include, but are not limited to, stem cell factor (SCF), thrombopoietin (TPO), or human Flt-3 ligand (FL), interleukin-6 (IL-6), interleukin-11 (IL-11), insulin like growth factor binding protein 1 (IGFBP1); insulin like growth factor binding protein 2 (IGFBP2), angiopoietin like protein 1 (ANGPTL1), angiopoietin like protein 3 (ANGPTL3), angiopoietin like protein 4 (ANGPTL4), and angiopoietin like protein 5 (ANGPTL5) (see, e.g., Fan et al. (2014) Stem Cell Res. Ther. 5: 71-80; and Blank et al. (2012) Eur. J. Haematol. 89:198-205).

In one embodiment, the stem cell is cultured in a medium comprising one or more cytokines. In one embodiment, the stem cell is cultured in a medium comprising two or more cytokines. In one embodiment, the stem cell is cultured in a medium comprising three or more cytokines. In one embodiment, the stem cell is cultured in a medium comprising four or more cytokines. In one embodiment, the stem cell is cultured in a medium comprising five or more cytokines.

In certain embodiments, the stem cells is cultured in a medium comprising one or more cytokines before the cell is contacted with a CRISPR/Cas9 component. In certain embodiments, the stem cell is cultured in a medium comprising one or more cytokines after the cell has been contacted with a CRISPR/Cas9 component. In certain embodiments, the stem cell is cultured in a medium comprising one or more cytokines before and after the cell is contacted with a CRISPR/Cas9 component. In one embodiment, the stem cell is cultured in a medium comprising a cytokine (e.g., a cytokine described herein) for at least 1, 2, 3, 4, 5, 6, 7, 8, 9, 10, 11, 12, 13 or 14 days. In one embodiment, the stem cell is cultured in a medium comprising a cytokine (e.g., a cytokine described herein) for less than 14, 13, 12, 11, 10, 9, 8, 7, 6, 5, 4, 3, 2, or 1 days. In one embodiment, the stem cell is cultured in a medium comprising a cytokine (e.g., a cytokine described herein) for more than 0.5, 1, 2, 3, 4, 5, 6, 7, 8, 9, 10, 11, 12, 13, or 14 days. For example, the stem cell (e.g., stem or progenitor cell, e.g., hematopoietic stem/progenitor cell) can be cultured for 1-3 days in the following medium: StemSpan SFEM (Stem Cell Technologies) containing 1% penicillin/streptomycin and supplemented with 50-100 ng/mL each of human stem cell factor (SCF), human thrombopoietin (TPO), and human Flt-3 ligand (FL). The medium may also include one or more of basic fibroblast growth factor (bFGF), vascular endothelial growth factor (VEGF), or interleukin-11 (IL-11).

Signal Transduction Activators or Repressors

After obtaining, generating, and/or isolating stem cells, but before contacting the cell with a CRISPR/Cas9 component (e.g., a Cas9 molecule, a gRNA molecule, or both, and optionally a donor template nucleic acid), the stem cell can be cultured in a medium containing one or more signal transduction activators or repressors, e.g., in addition to the stem cell viability enhancer. Additionally, after contacting the cell with a CRISPR/Cas9 component, the stem cell can be cultured in a medium containing one more more signal transduction activators or repressors, e.g., in addition to the stem cell viability enhancer.

In one embodiment, the stem cell is further contacted with a signal transduction activator or repressor before contact with the CRISPR/Cas9 component. In another embodiment, the stem cell is further contacted with a signal transduction activator or repressor after contact with the CRISPR/Cas9 component. In another embodiment, the stem cell is further contacted with a signal transduction activator or repressor both before and after contact with the CRISPR/Cas9 component.

The following signal transduction pathways are involved in balancing the generation, self-renewal, maintenance, proliferation, and cell fate decisions in stem cells, e.g., HSCs. The key pathways that regulate stem cells, e.g., HSCs, include the Notch, TGFβ-SMAD, CXCR5, and Wnt signaling pathways (Mendelsen and Frenette (2014) Nature Medicine 20(8): 833-46). Certain stem cells, e.g., HSCs, express Notch, Wnt, and TGFβ receptors on the cell surface and binding of cognate ligands to these receptors on stem cells can alter the self-renewal, proliferation, and differentiation potential of these cells. Coordinated sequential or simultaneous regulation (e.g., activation or repression) of these signal transduction pathways in stem cells, e.g., HSCs, can be used to maintain self-renewal, multipotency, and proliferation potential which may be perturbed upon stem cell contact with a CRISPR/Cas9 component or a delivery system for a CRISPR/Cas9 component. While not wishing to be bound by theory, it is believed that, In one embodiment, acute pretreatment (e.g., before contact with a CRISPR/Cas9 component) and posttreatment (e.g., after contact with a CRISPR/Cas9 component) of stem cells with signal transduction pathway activating or repressive factors can promote cell survival and prevent cell death. In one embodiment, the methods described herein use signal transduction ligands that bind to cognate receptors on stem cells to preserve stem cell multipotency, self-renewal, proliferative potential and to prevent senescence, and cell death (e.g., apoptosis, autophagy, or necrosis). Table 2 describes exemplary signal transduction pathways and their modulators which can be used in accordance with the methods described herein, each of which are described in more detail in the subsections, below.

TABLE 2

| Signal Transduction pathway | Ligand | Receptor on stem cell | Inhibitor |
|---|---|---|---|
| Notch | DLL, JAG | Notch1, Notch2 | shRNA, antibody |
| TGF-β | TGFβ, BMP4 | TGFβR | SB 431542 |
| CXCR4 | SDF1, CXCL12 | CXCR4 | Antibody, AMD3100 |
| Wnt | Wnt3a, Wnt5a | Frizzled, LRP5, LRP6 | DKK1, antibody, small molecule inhibitor | a. Notch Signaling Pathway

Vascular endothelial cells and stromal cells in the bone marrow microenvironment produce membrane bound Notch ligands (delta-like ligands [DLL] and Jagged [JAG]) that bind to cognate receptors on certain stem cells, e.g., HSCs. Notch ligands compete for binding to Notch1, Notch2 receptors on stem cells (e.g., HSCs) and the relative binding of different Notch ligands balances stem cell (e.g., HSC) self-renewal, maintenance, proliferation, and differentiation. For example, JAG1 has been shown to be required for homeostatic and regenerative hematopoiesis in vivo (Poulos et al. (2013) *Cell Reports* 4(5): 1022-1034). Co-culture of cord blood HSCs with Notch ligand delta-like ligand 1 (DLL1) immobilized on plastic culture plate (Immobilized Delta-1$^{ext-IgG}$) supports expansion of CD34$^+$ cells and has been shown to be safe in an allogeneic double cord blood transplantation clinical study (Delaney et al. (2010) *Nature Medicine* 16: 232-6).

In one embodiment, the stem cell is contacted with one or more Notch signaling modulators. In one embodiment, the Notch signaling modulator is a Notch ligand, e.g., DLL or JAG. In one embodiment, the Notch signaling modulator is an RNAi agent, an oligonucleotide, an antibody, or an eiCas9 molecule fused to activator/repressor paired with a Notch pathway specific gRNA. The stem cell is contacted with the Notch signaling modulator before, during, and/or after contact with a CRISPR/Cas9 component, e.g., a Cas 9 molecule, a gRNA molecule, or both, and optionally a donor template nucleic acid. While not wishing to be bound by theory, it is believed that contacting the stem cell with a Notch signaling modulator can regulate stem cell entry into or exit from the cell cycle in order to preserve cell viability and to support limited stem cell proliferation. The methods described herein allow for long-term engraftment of stem cells in human patients.

b. TGFβ Signaling Pathway

Transforming growth factor beta (TGFβ) is a growth factor that is present in the hematopoietic stem/progenitor cell niche that regulates HSC dormancy and hibernation (Yamzaki, 2009, Blood, 113:1250-1255). TGFβ is produced by nonmyelinating Schwann cells in proximity to blood vessels in the marrow (Yamazaki et al., 2011, Cell, 147: 1146-1158), indicating that regulation of HSC dormancy occurs in the vascular (endothelial) niche. Treatment of zebrafish embryos with a small molecule inhibitor of TGFβ signaling (SB 431542) has been shown to induce HSC proliferation in the perivascular niche (Tamplin et al., 2014, Cell, 160:241-252). Therefore, blocking TGFβ signaling with neutralizing antibodies or with small molecule inhibitors, e.g., SB 431542 is a strategy for maintenance of stem cell, e.g., HSC, proliferative potential upon exposure to foreign nucleic acids, e.g., Cas9 mRNA or gRNA. Alternatively, contact between stem cells (e.g., HSCs) and TGFβ immediately after exposure to genotoxic stress can force the stressed stem cell into hibernation to prevent cell death due to the acute exposure to foreign nucleic acids.

In one embodiment, the stem cell is contacted with one or more TGFβ signaling modulators. In one embodiment, the TGFβ signaling modulator is a TGFβ ligand. In another embodiment, the TGFβ signaling modulator is a TGFβ signaling antagonist, e.g., SB43152 or an anti-TGFβR antibody). The stem cell is contacted with the TGFβ signaling modulator before, during, and/or after contact with a CRISPR/Cas9 component, e.g., a Cas 9 molecule, a gRNA molecule, or both, and optionally a donor template nucleic acid. In one embodiment, the TGFβ signaling modulator is an RNAi agent, an oligonucleotide, antibody, or an eiCas9 molecule fused to activator/repressor paired with a TGFβ pathway specific gRNA. While not wishing to be bound by theory, it is believed that, In one embodiment, contacting the stem cell with a TGFβ signaling modulator can regulate stem cell entry into or exit from the cell cycle in order to preserve cell viability and to support limited stem cell proliferation.

c. CXCR4 Chemokine Receptor

CXCR4 is a chemokine receptor present on the cell surface of lymphocytes and HSCs. Stromal derived factor-1 (SDF1 or CXCL12) is the ligand that binds to CXCR4 and is produced by cells in the bone marrow and in other tissues. The SDF1/CXCR4 signaling axis regulates HSC localization and retention in the bone marrow and migration into the peripheral blood and other tissues, as the cells migrate down the chemokine gradient. Small molecules have been developed to regulate the migration of HSCs that exploit the SDF1/CXR4 chemokine axis. For example, use of dmPGE2 upregulates expression of CXCR4 to increase homing to and retention of cord blood cells to the bone marrow upon transplantation (Cutler et al., 2013, Blood, 122 (17): 3074-3081). As another example, plerixiflor (AMD3100), a CXCR4 antagonist that disrupts the binding between CXCR4 and SDF1, facilitates mobilization of HSCs from the bone marrow into the blood for collection and use in allogeneic or autologous transplantation. Given that CXCR4 signaling plays a role in cell cycle progression and survival, manipulation of CXCR4 signaling in stem cells, e.g., ex vivo, can be used to prevent stem cell death (e.g., apoptosis) and to regulate cell cycle progression and proliferation.

In one embodiment, the stem cell is contacted with a CXCR4 modulator. In one embodiment, the CXCR4 modulator is a CXCR4 agonist, e.g., dmPGE2. In another embodiment, the CXCR4 modulator is a CXCR4 antagonist, e.g., plerixiflor (AMD3100). The stem cell is contacted with the CXCR4 modulator before, during, and/or after contact with a CRISPR/Cas9 component, e.g., a Cas 9 molecule, a gRNA molecule, or both, and optionally a donor template nucleic acid. While not wishing to be bound by theory, it is believed that, In one embodiment, contacting the stem cell with a CXCR4 modulator can maintain stem cell self-renewal, multipotency, or proliferation potential.

d. Wnt Signaling Pathway

Overexpression of the canonical Wnt pathway inhibitor DKK1 can decrease hematopoietic reconstitution in vivo (Fleming et al., 2008, Cell Stem Cell, 2(3):274-283). Deletion of the canonical Wnt ligand Wnt3a can also reduce self-renewal and reconstitution potential of HSCs. These findings indicate a role for canonical Wnt signaling in HSC self-renewal and maintenance. Conversely, noncanonical Wnt signaling (e.g., through Wnt5a ligand) can inhibit canonical Wnt signaling in HSCs, blocking ex vivo proliferation of HSCs and increasing repopulation potential (Nemeth et al., 2007, Proceedings of the National Academy of Sciences, 104(39):15436-41).

Certain stem cells, e.g., HSCs express noncanonical Wnt receptors. Binding of Wnt ligands to noncanonical Wnt receptors (e.g., Frizzled 8 [Fzd8]) prevents nuclear localization of the nuclear factor of activated T cell (NFAT) thereby preventing interferon expression and preserving HSC quiescence (Sugimura et al., 2012, Cell, 150(2):351-365). Stress associated with exposing the cells to virus, foreign nucleic acid or protein, perturbation of oxygen tension (e.g., culturing the cells in hyperoxic or hypoxic conditions) or exposure to electric fields (e.g., electroporation of cells to deliver foreign nucleic acids or proteins) may alter the balance between noncanonical Wnt signaling (which prevents cell activation and maintains self-renewal) and canonical Wnt signaling (which activates cells and induces cell proliferation which could lead to exhaustion). Certain stem cells, e.g., HSCs, can be highly sensitive to Wnt signaling.

Therefore, careful titration of Wnt ligands can be used to maintain certain stem cells, e.g., HSCs, and to prevent the stress response that may occur upon contact with a CRISPR/Cas9 component, e.g., delivered by electroporation or viruses.

In one embodiment, the stem cell is contacted with one or more modulators of Wnt signaling. In one embodiment, the stem cell is contacted with a canonical Wnt ligand. In another embodiment, the stem cell is contacted with a noncanonical Wnt ligand. In yet another embodiment, the stem cell is contacted with an inhibitor of Wnt signaling pathway. Exemplary inhibitors of Wnt signaling pathway include, but are not limited to, an neutralizing antibody to a specific Wnt receptor, or an RNAi agent (e.g., an shRNA) against a downstream target of Wnt signaling including but not limited to NFAT and IFNγ). The stem cell is contacted with the Wnt signaling modulator before, during, and/or after contact with a CRISPR/Cas9 component, e.g., a Cas 9 molecule, a gRNA molecule, or both, and optionally a donor template nucleic acid.

Inhibitors of Programmed Cell Death

After obtaining, generating, and/or isolating stem cells, but before contacting the cell with a CRISPR/Cas9 component (e.g., a Cas9 molecule, a gRNA molecule, or both, and optionally a donor template nucleic acid), the stem cell can be cultured in a medium containing one or more inhibitors of cell death, e.g., in addition to the stem cell viability enhancer. Additionally, after contacting the cell with a CRISPR/Cas9 component, the stem cell can be cultured in a medium containing one more more inhibitors of cell death, e.g., in addition to the stem cell viability enhancer.

In one embodiment, the stem cell is further contacted with a molecule, e.g., in a medium, that inhibits programmed cell death or senescence. In one embodiment, the stem cell is contacted with the compound within 24 hours (e.g., within 12 hours or 6 hours) before contact with a CRISPR/Cas9 component, e.g., a Cas9 molecule, a gRNA molecule, or both, and optionally a donor template molecule. In another embodiment, the stem cell is contacted with the compound within 24 hours (e.g., within 12 hours or 6 hours) after contact with a CRISPR/Cas9 component, e.g., a Cas9 molecule, a gRNA molecule, or both, and optionally a donor template molecule. In another embodiment, the stem cell is contacted with the compound within 24 hours (e.g., within 12 hours or 6 hours) before and within 24 hours (e.g., within 12 hours or 6 hours) after contact with a CRISPR/Cas9 component, e.g., a Cas9 molecule, a gRNA molecule, or both, and optionally a donor template molecule. In one embodiment, acute pretreatment (e.g., before contact with a CRISPR/Cas9 component) and posttreatment (e.g., after contact with a CRISPR/Cas9 component) of stem cells with a compound that inhibits programmed cell death or senescence can increase stem cell survival or proliferative potential upon exposure to foreign nucleic acid, e.g., by transient inhibition of programmed cell death, including autophagy, apoptosis, and senescence.

In one embodiment, stem cells comprises, or is contacted with, an eiCas9 molecule, e.g., fused to a transcriptional repressor or transcriptional activator (e.g., KRAB) to regulate a target gene that is associated with programmed cell death or senescence. While not wishing to be bound by theory, it is believed that, In one embodiment, regulation of a target gene associated with programmed cell death or senescence, e.g., by an eiCas9 molecule, can improve cell survival, viability, proliferation without loss of multipotency, and maintain cellular fitness, upon acute exposure to a CRISPR/Cas9 component.

In one embodiment, the stem cell is contacted with a combination of: a stem cell viability enhancer, along with a cytokine and/or a signal transduction activator or repressor up to 120 hours (e.g., up to 96, 72, 60, 48, 36, or 24 hours) before and up to 72 hours after contact with the CRISPR/Cas9 component(s), e.g., to increase gene editing and survival; to decrease cell death (e.g., apoptosis, autophagy or necrosis), or to increase engraftment. In one embodiment, instead of direct contact with one of the cytokines or small molecules disclosed herein, the stem cell is contacted with an inhibitor (e.g., an antibody) that binds to the cognate receptor of said cytokine or small molecule, e.g., a receptor described in Table 3.

TABLE 3

| Stem cell viability enhancer | Category | Binding Partner |
| --- | --- | --- |
| Stem cell factor (SCF) | cytokine | c-kit |
| Thrombopoietin (TPO) | cytokine | MPL |
| Flt-3 ligand (FL) | cytokine | FLT3 |
| Basic Fibroblast Growth Factor (FGF) | cytokine | FGFR 1 |
| VEGF | cytokine | VEGFR2 |
| Interleukin-11 | cytokine | IL11RA |
| IGFBP1, IGFBP2, IGF1, IGF2, IGF3 | cytokine | IGFR |
| Angiopoietins (e.g., ANG1) and Angiopoietin like proteins (e.g., ANGPTL4) | cytokine | Tie1/Tie2 |
| 16, 16, dimethylprostaglandin E2 (dmPGE2) | small molecule | EP2, EP4 |
| StemRegenin1 (SR1) | small molecule | AhR |
| UM171 | small molecule | unknown |
| UM729 | small molecule | unknown |

Introduction of Truncated Cell Surface Antigens

Purification of modified stem cells expressing a cell surface antigen or a selectable marker would provide a means to insure that a CRISPR/Cas9 component, e.g., a Cas9 molecule, a gRNA molecule, or both, and optionally a donor template nucleic acid, has been delivered to the cells, e.g., ex vivo. Expression of a cell surface antigen by targeted cells would also allow for tracking modified stem cells in vivo.

In one embodiment, the stem cell comprises, or is contacted with, a gene encoding a cell surface antigen or a selectable marker. In one embodiment, the cell surface antigen or selectable marker is truncated CD19 (tCD19). In another embodiment, the cell surface antigen or selectable marker is truncated CD20 (tCD20). The full-length cell surface receptors CD19 and CD20 are naturally expressed on B-lymphocytes. Truncating CD19 or CD20 prevents intracellular signaling through the receptor since the cytoplasmic domain is removed (Tey et al., 2007, Biol Blood Marrow Transplant, 13(8):913-24). Expression of the extracellular domain of CD19 or CD20 would allow for sorting on the cells and for tracking the cells in vivo (e.g., by taking blood draws and staining the cells with anti-human CD19 or anti-human CD20 antibodies in order to monitor engraftment of the gene-edited cells). In one embodiment, the tCD19 or tCD20 transgene is delivered as a donor template nucleic acid. In one embodiment, the stem cell is contacted with one or more gRNA molecules comprising a targeting domain that is complementary to a target domain from the region into which the transgene is integrated. In one embodiment, the tCD19 or tCD20 transgene is integrated into the genome, e.g., at a safe harbor locus, e.g., the AAVS1 safe harbor locus. While not wishing to be bound by theory, it is believed that, In one embodiment, introduction or co-introduction (multiplex genome editing) of a truncated CD19 or CD20 cell surface antigen can be used to purify genome edited cells ex vivo or to monitor genome edited cells in vivo.

Introduction of Chemotherapy Resistance Transgenes or Suicide Genes

The methods described herein allow for regulation of stem cells in vivo or ex vivo, such that modified stem cells with desired properties can be selected or expanded, or modified stem cells with undesired properties (e.g., leukemic transformation) can be eliminated.

In one embodiment, the stem cell comprises, or is contacted with, a safety switch, which allows for selection of desired stem cells, e.g., ex vivo or in vivo, or elimination of undesired stem cells, e.g., ex vivo or in vivo. In one embodiment, the safety switch contains a suicide gene and/or a gene encoding a chemotherapy selection marker. For example, the stem cells can contain a safety switch that comprises of two components: 1) truncated cell surface antigen (tCD20) and inducible suicide gene that can be used to sort genome edited cells ex vivo, can be used to track cells in vivo, and can also be used to eliminate cells in the event of leukemic transformation in vivo by administration of Rituximab (anti-CD20 monoclonal antibody therapy) to the patient; and 2) a drug-inducible chemotherapy resistance gene (e.g., the P140K variant of methylguanine methyltransferase [P140K MGMT]) which upon treatment of the patient with alkylating chemotherapy (O6-benzylguanin [O6BG] and BCNU) would in vivo select for the genome edited cells by removal of the unedited cells, thereby increasing the in vivo repopulation of the bone marrow with genome edited cells.

In one embodiment, the stem cell comprises, or is contacted with, a suicide gene. In one embodiment, the suicide gene encodes an inducible Caspase-9 (iCasp9). In one embodiment, the stem cell is further contacted with a chemical inducer of dimerization, e.g., AP1903 or AP2018. While not wishing to be bound by theory, it is believed that Caspase-9 induces apoptosis upon treatment with a chemical inducer of dimerization (Di Stasi et al., 2011, New Eng Journal Med, 365:1673-1683). In another embodiment, the suicide gene encodes a truncated CD20 (tCD20). In one embodiment, the stem cell is further contacted with an anti-CD20 antibody, e.g., Rituximab. While not wishing to be bound by theory, it is believed that anti-CD20 antibody can induce an immune response and lead to death of cells that express CD20 (Redman et al., 2015, Mol Immunol, S0161-5890 (15):00361-2).

In one embodiment, the stem cell comprises, is contacted with, a gene encoding a chemotherapy selection marker. In one embodiment, the chemotherapy selection marker is a variant of methylguanine methyltransferase (e.g., the P140K variant of methylguanine methyltransferase). In one embodiment, the stem cell is further contacted with a chemotherapeutic agent, e.g., O6BG/BCNU. While not wishing to be bound by theory, it is believed that, In one embodiment, use of the P140K variant of methylguanine methyltransferase with O6BG/BCNU chemotherapy is effective in increasing the level of gene-modified hematopoietic stem/progenitor cells in the bone marrow after delivery by lentivirus transduction (Gori et al., 2012, Cancer Gene Therapy, 19(8):1523-9; Beard et al., 2010. J Clin Invest, 120(7):2345-54).

In one embodiment, the transgene is provided on or delivered as a donor template nucleic acid. In one embodiment, the stem cell is contacted with one or more gRNA molecules comprising a targeting domain which is complementary with a target domain from a region into which the transgene is integrated. In one embodiment, the transgene is integrated into the genome, e.g., at a safe harbor locus, e.g., the AAVS1 safe harbor locus. In one embodiment, the transgene comprises a tCD20-2A-P140K bicistronic transgene cassette.

Culturing Stem Cells

The stem cell can be cultured either before, after, or both before and after contacting with a CRISPR/Cas9 component, e.g., a Cas9 molecule, a gRNA molecule, or both, and optionally a donor template nucleic acid, as described herein. In one embodiment, the stem cell is co-cultured with an endothelial cell, e.g., a human endothelial cell (e.g., VeraVec™, perivascular endothelium, or other endothelial cells). In another embodiment, the stem cell is co-cultured with a mesenchymal stromal cell, e.g., a human mesenchymal stromal cell. In one embodiment, the endothelial or mesenchymal co-culture cell is genetically modified to express one or more membrane bound ligands that activate or repress Notch, Wnt, TGFβ, and/or CXCR4 signaling pathways of the stem cell. In one embodiment, the stem cell is cultured in a 2-D culture system. In another embodiment, the stem cell is cultured in a 3-D culture system. For example, the stem cells can be cultured in a system designed for culturing stem or progenitor cells, e.g., HSCs (e.g., NANEX™ expansion plates, AK-polyfibers). In one embodiment, the stem cell is cultured under hypoxia growth conditions, e.g., by placing the cell culture vessel into a hypoxia chamber. For example, the oxygen tension of the hypoxia chamber can range from 10% to 0.1% $O_2$, e.g., from 5% to 0.5% $O_2$, e.g., 10% or less, 8% or less, 5% or less, 3% or less, 2% or less, 1% or less, 0.5% or less, or 0.2% or less $O_2$. In one embodiment, the stem cell is cultured for at least 1, 2, 3, 4, 5, 6, or 7 days. In one embodiment, the stem cell is purified from the endothelial or stromal support cell before transplantation.

Modification of gRNA Molecules and Template Molecules

During virus-host co-evolution, viral RNA capping that mimics capping of mRNA evolved to allow viral RNA to escape detection from the cell's innate immune system (see, e.g., Delcroy et al. (2012) *Nature Reviews Microbiology* 10: 51-65). Toll-like receptors in stem cells (e.g., HSCs) sense the presence of foreign single and double stranded RNA that can lead to innate immune response, cell senescence, and programmed cell death (Kajaste-Rudnitski and Naldini (2015) *Human Gene Therapy* 26: 201-9). Results from initial experiments showed that human HSCs electroporated with unmodified (e.g., gRNAs synthesized without a 5' cap or 3' polyA-tail) gRNA molecules and Cas9 mRNA led to reduced cell survival, proliferation potential, or multipotency (e.g., loss of erythroid differentiation potential and skewed myeloid differentiation potential) compared to cells electroporated with GFP mRNA alone. It is likely that that cell senescence and apoptosis was due to the stem cell sensing of foreign nucleic acid and induction of an innate immune response, and subsequent induction of programmed cell death and loss of proliferative and differentiation potential. To evade the cell's innate immune response to foreign nucleic acid, modifying the gRNA molecules to resemble mRNA (e.g., addition of 5' cap and 3' polyA tail) can prevent innate immune response in the cell, interferon response in the cell, cell senescence, or programmed cell death associated with sensing the foreign nucleic acid.

"Modified gRNA molecule" or "modified gRNA", as used herein, refers to a gRNA molecule that has an improved half life after being introduced into a cell as compared to a non-modified gRNA molecule after being introduced into a cell. In one embodiment, the modified gRNA molecule does not activate an innate immune response in a cell upon the cell being exposed (e.g., electroporated) to the gRNA molecule. In one embodiment, the modified gRNA molecule activates a reduced innate immune response in a cell upon the cell being exposed to the gRNA molecule, as compared to the innate immune response in the same type of cell upon the cell bing exposed to an unmodified gRNA molecule. In another embodiment, the modified gRNA molecule does not activate a programmed cell death pathway (e.g., an apoptotic cell death pathway, a necrosis cell death pathway (e.g., a necroptosis cell death pathway), an autophagic cell death pathway, an aponecrosis cell death pathway, a ferroptosis cell death pathway, an eryptosis cell death pathway, an aponecrosis cell death pathway, or an anoikis cell death pathway) in a cell upon the cell being exposed to the gRNA molecule. In some embodiments, the modified gRNA molecule does not activate a caspase-dependent cell death pathway. In another embodiment, the modified gRNA molecule does not activate a caspase-independent cell death pathway.

In one embodiment, a modified gRNA molecule comprises a 5'-end modification. In one embodiment, the 5'-end modification is a selected from the group consisting of: a G(5')ppp(5')G cap analog, a m7G(5')ppp(5')G cap analog, or a 3'-O-Me-m7G(5')ppp(5')G anti reverse cap analog (ARCA). In one embodiment, the 5'-end modification is a phosphorothioate modification. In one embodiment, the gRNA molecule comprises a 3'-end modification. In one embodiment, the 3'-end modification is a poly adenine tail. In one embodiment, the 3'-end modification is a phosphorothioate modification.

In one embodiment, the stem cell is contacted with a capped and tailed gRNA molecule. In one embodiment, as used herein to refer to gRNA molecules, the term "capped" refers to a gRNA having a 5' end cap structure. In some embodiment, the 5-end cap structure is a selected from the group consisting of: a G(5')ppp(5')G cap analog, a m7G(5')ppp(5')G cap analog, or a 3'-O-Me-m7G(5')ppp(5')G anti reverse cap analog (ARCA). In one embodiment, as used herein to refer to gRNA molecules, the term "tailed" refers to a gRNA having a 3'-end modification. In one embodiment, the 3'-end modification is a poly adenine tail. In one embodiment, the 3'-end modification is a phosphorothioate modification. In one embodiment, the gRNA molecule comprises a 3' poly-adenine tail. In certain embodiment, said poly-Adenine tail is 5, 10, 15, 20, 25, 30, 35, 40 or more adenine residues in length. In one embodiment, the stem cell is contacted with a Cas9 molecule/gRNA molecule complex containing a capped and tailed gRNA molecule. While not wishing to be bound by theory, it is believed that, In one embodiment, contacting stem cells with capped and tailed gRNA molecules can increase survival of modified stem cells, preserve stem cell multipotency, or viability, increase cell engraftment, or prevent cell senescence and programmed cell death.

In one embodiment, the stem cell is further contacted with a donor template nucleic acid. In one embodiment, the donor template nucleic acid is a single stranded oligodeoxynucleotide. While not wishing to be bound by theory, and similar to the modified gRNA molecules discussed above, in order to evade the cell's innate immune response to foreign nucleic acid, modifying the donor template nucleic acid to comprise a 5'-end modification, a 3'-end modification, or both a 5'-end modification and a 3'-end modification can also prevent innate immune response in the cell, interferon response in the cell, cell senescence, or programmed cell death associated with sensing the foreign nucleic acid. In some embodiments, the donor template nucleic acid comprises a 5'-phosphorothioate modification. In some embodiments, the donor template nucleic acid comprises a 3'-phosphorothioate modification. In some embodiments, the donor template nucleic acid comprises both a 5'-phosphorothioate modification and a 3'-phosphorothioate modification.

Methods to Treat or Prevent Diseases

Methods and compositions described herein provide for a therapy, e.g., a one-time therapy or a multi-dose therapy that treats or prevents a disease, e.g., a disease described herein. In one embodiment, the method for treating or preventing a disease alter a cell, e.g., a cell described herein, e.g., ex vivo or in vivo. Any type of cell that is associated with the disease can be altered by the methods described herein. For example, the cell is a circulating blood cell, a mobilized blood cell, a bone marrow cell, a myeloid progenitor cell, a lymphoid progenitor cell, a hematopoietic stem/progenitor cell (HSC), a multipotent progenitor cell, a lineage restricted progenitor cell, an endothelial cell, or a mesenchymal stromal cell. In another embodiment, the method for treating or preventing a disease alters a gene, e.g., a gene described herein, e.g., by CRISPR/Cas-mediated gene editing. Alteration of the cell or gene (e.g., correction, knockout, knockin, knockdown, or activation) can be performed prior to disease onset or after disease onset. Exemplary diseases that can be treated or prevented by the methods described herein include, but are not limited to, the diseases listed in Table 4. Exemplary genes that can be altered by the methods described herein include, but are not limited to, the genes listed in Table 4.

In one embodiment, a gene is knocked into a safe harbor locus (e.g., the AAVS1 safe harbor locus) in a stem cell, e.g., an HSC, using a CRISPR/Cas-mediated method, or any other knockin or gene delivery methods including Sleeping Beauty transposon, lentivirus vector, or adenoassociated viral vector.

In one embodiment, the gene encodes a secreted, soluble protein. While not wishing to be bound by theory, it is believed that, In one embodiment, knockin of a gene encoding a secreted, soluble blood protein can be used to treat or cure disease, including diseases listed in Table 4, e.g., a lysosomal storage diseases, glycogen storage diseases, mucopolysaccharoidoses, or any disease in which the secretion of a protein will ameliorate the disease. In one embodiment, the disease is sickle cell disease (SCD). In another embodiment, the disease is β-thalassemia.

In one embodiment, the disease is associated with deficiency of a circulating blood protein. Exemplary diseases include, but are not limited to, hemophilia (e.g., hemophilia A or hemophilia B), A1AT deficiency, or lysosomal acid lipase deficiency. While not wishing to be bound by theory, it is believed that, In one embodiment, introducing a gene encoding a secreted, soluble blood protein associated with the deficiency can increase the circulating blood levels of the protein and therefore ameliorate or cure the disease. In one embodiment, the disease is hemophilia, e.g., hemophilia A or hemophilia B. In one embodiment, the gene is the F8 gene, coding for clotting factor VIII. In one embodiment, the method includes knocking in the F8 gene, thereby treating or preventing hemophilia A. In another embodiment, the gene is the F9 gene, coding for clotting factor IX. In one embodiment, the method includes knocking in the F9 gene, thereby treating or preventing hemophilia B. In one embodiment, the disease is A1AT deficiency. In one embodiment, the gene is the SERPINA1 gene, coding for alpha-1-antitrypsin. In one embodiment, the method includes knocking in the SERPINA1 gene, thereby treating or preventing A1AT deficiency. In one embodiment, the disease is lysosomal acid lipase deficiency. In one embodiment, the gene is the LAL gene, coding for lysosomal acid lipase, thereby treating or preventing lysosomal acid lipase deficiency.

In one embodiment, the disease is diabetes. In one embodiment, the gene codes for a secreted, soluble blood protein. While not wishing to be bound by theory, it is believed that, In one embodiment, knockin of a gene encoding a secreted, soluble blood protein, e.g., under the control of a druggable, inducible or selectable promoter, can increase the circulating blood levels of this protein and therefore ameliorate or cure the disease. In one embodiment, the gene is the INS gene, coding for the protein insulin. In one embodiment, the gene is the GCG gene, coding for the protein glucagon. In one embodiment, the method includes knocking in the INS gene or GCG gene, e.g., under the control of a druggable, inducible or selectable promoter, thereby treating or preventing diabetes.

In one embodiment, the disease is growth hormone deficiency. In one embodiment, the gene is the GH gene, coding for growth hormone. While not wishing to be bound by theory, it is believed that, In one embodiment, knockin of the GH gene, e.g., under the control of a druggable, inducible or selectable promoter, can increase the circulating growth hormone levels and therefore ameliorate or cure the disease. In one embodiment, the method includes knocking in the GH gene, e.g., under the control of a druggable, inducible or selectable promoter, thereby treating or preventing growth hormone deficiency.

In one embodiment, the disease is a cancer, e.g., a hematologic cancer. In one embodiment, the gene is a gene overexpressed in the cancer. While not wishing to be bound by theory, it is believed that, In one embodiment, knockdown of the gene, e.g., by an eiCas9 molecule fused to a transcriptional repressor, improves or cures the disease. In one embodiment, the gene is the EGFR gene. In one embodiment, the method includes activating the EGFR gene, thereby treating or preventing cancer progression and metastasis.

In one embodiment, the disease is hereditary angioedema. In one embodiment, the gene is a gene underexpressed in hereditary angioedema. While not wishing to be bound by theory, it is believed that, In one embodiment, upregulation or activation of the gene, e.g., by an eiCas9 molecule fused to a transcriptional activator, improves or cures the disease. In one embodiment, the gene is the C1INH gene. In one embodiment, the method includes activating the C1INH gene, thereby treating or preventing hereditary angioedema.

In one embodiment, the disease is Von Willebrand disease. In one embodiment, the gene is underexpressed in Von Willebrand disease. While not wishing to be bound by theory, it is believed that, In one embodiment, upregulation or activation of the gene, e.g., by an eiCas9 molecule fused to a transcriptional activator, improves or cures the disease. In one embodiment, the gene is the VWF gene. In one embodiment, the method includes activating the VWF gene, thereby treating or preventing Von Willebrand disease.

In one embodiment, the disease is hereditary or acquired anemia. In one embodiment, the gene is a gene underexpressed in hereditary or acquired anemia. While not wishing to be bound by theory, it is believed that, In one embodiment, transient upregulation or activation of the gene, e.g., by an eiCas9 molecule fused to a transcriptional activator, improves or cures the disease. In one embodiment, the gene is the EPO gene. In one embodiment, the method includes activating the EPO gene transiently, thereby treating or preventing the hereditary or acquired anemia.

In one embodiment, the disease is neutropenia. In one embodiment, the gene is a gene underexpressed in neutropenia. While not wishing to be bound by theory, it is believed that, In one embodiment, transient upregulation or activation of the gene, e.g., by an eiCas9 molecule fused to a transcriptional activator, can improve or cure the disease. In one embodiment, the gene is the CSF2 gene. In one embodiment, the method includes activating the CSF2 gene transiently, thereby treating or preventing neutropenia.

In one embodiment, the disease is a growth disorder. In one embodiment, the gene is a gene underexpressed in the growth disorder. While not wishing to be bound by theory, it is believed that, In one embodiment, transient upregulation or activation of the gene, e.g., by an eiCas9 molecule fused to a transcriptional activator, can improve or cure the disease. In one embodiment, the gene is GH1. In one embodiment, the method includes activating the GH1 gene transiently, thereby treating or preventing the growth disorder.

In one embodiment, the disease is an infectious disease, an autoimmune disease, an inflammatory disease, a rheumatic disease, or an oncologic disease. In one embodiment, the gene encodes a cytokine, a chemokine, an interleukin, or an inflammatory protein. While not wishing to be bound by theory, it is believed that, In one embodiment, downregulation or inhibition of a gene encoding a cytokine, a chemokine, an interleukin, or an inflammatory protein, either transiently or permanently, e.g., by an eiCas9 molecule (e.g., an inducible eiCas9 molecule) fused to a transcriptional repressor, can ameliorate or cure disease. In one embodiment, the disease is a hematologic cancer. In one embodiment, the gene is the EPOR gene. In one embodiment, the method includes knocking down the EPOR gene, thereby treating or preventing the hematologic cancer. In one embodiment, the disease is rheumatoid arthritis. In one embodiment, the gene is the TNF gene. In one embodiment, the method includes knocking down the TNF gene, thereby treating or preventing rheumatoid arthritis. In one embodiment, the disease is an inflammatory disease. In one embodiment, the gene is the C5 gene. In one embodiment, the method includes knocking down the C5 gene, thereby treating or preventing the inflammatory disease.

In one embodiment, the disease is an infectious disease, an autoimmune disease, an inflammatory disease, a rheumatic disease, or an oncologic disease. In one embodiment, the gene encodes a cytokine, a chemokine, an interleukin, or an inflammatory protein. While not wishing to be bound by theory, it is believed that, In one embodiment, upregulation or activation of a gene encoding a cytokine, a chemokine, an interleukin, or an inflammatory protein, either transiently or permanently, e.g., by an eiCas9 molecule (e.g., an inducible eiCas9 molecule) fused to a transcriptional activator, can ameliorate or cure disease. In one embodiment, the disease is multiple sclerosis. In one embodiment, the gene is the IFNB1 gene. In one embodiment, the method includes activating the IFNB1 gene, thereby treating or preventing multiple sclerosis.

In one embodiment, the disease is an infectious disease, an autoimmune disease, an inflammatory disease, a rheumatic disease, or an oncologic disease. In one embodiment, the gene encodes a cytokine, a chemokine, an interleukin, or an inflammatory protein receptor. While not wishing to be bound by theory, it is believed that, In one embodiment, knockout of a gene encoding a cytokine, a chemokine, an interleukin, or an inflammatory protein, e.g., by an eaCas9 molecule, will ameliorate or cure disease. In one embodiment, the disease is HIV or AIDS. In one embodiment, the gene is CCR5. In another embodiment, the gene is the CXCR4 gene. In one embodiment, the method includes knocking out of the CCR5 gene, the CXCR4 gene, or both, thereby treating or preventing HIV or AIDS.

In one embodiment, the disease is stroke or myocardial infarction. In one embodiment, the gene encodes a soluble blood protein, e.g., a tissue plasminogen activator or a urinary plasminogen activator. While not wishing to be bound by theory, it is believed that, In one embodiment, upregulation or activation of the gene, e.g., transiently, e.g., by an eiCas9 molecule fused to a transcriptional, can ameliorate or prevent the disease, e.g., prevents ischemia or dissolves blood clots. In one embodiment, the gene is the PLAT gene. In one embodiment, the method includes activating the PLAT gene, thereby treating or preventing stoke or myocardial infarction.

In one embodiment, the disease is a hemoglobinopathy. In one embodiment, the gene contains a mutation that causes the hemoglobinopathy. In one embodiment, the gene does not contain a mutation that causes the hemoglobinopathy. While not wishing to be bound by theory, it is believed that, In one embodiment, knockout or correction of the gene can ameliorate or cure the disease. In one embodiment, the gene that contains a mutation is HBB, HBA1, or HBA2. In one embodiment, the method includes correcting a mutated HBB, HBA1, or HBA2 gene, thereby treating or preventing sickle cell disease, alpha thalassemia, or beta thalassemia. In one embodiment, the gene is BCL11A. In one embodiment, the method comprises knocking out the BCL11A gene, thereby treating or preventing sickle cell disease or beta thalassemia.

In one embodiment, the disease is an anemia. In one embodiment, the gene contains a mutation that causes the anemia, e.g., hemolytic anemia, e.g., due to red cell pyruvate kinase deficiency. While not wishing to be bound by theory, it is believed that, In one embodiment, knockin or correction of the gene can ameliorate or cure the anemia. In one embodiment, the gene is PKLR. In one embodiment, the method includes correcting knocking in a wild type PKLR gene or correcting a mutated PKLR gene, thereby treating or preventing the anemia, e.g., hemolytic anemia.

In one embodiment, the disease is a clotting factor disease, e.g., hemophilia A. In one embodiment, the gene contains a mutation that causes the clotting factor disease. While not wishing to be bound by theory, it is believed that, In one embodiment, correction of the gene can ameliorate or cure the clotting factor disease. In one embodiment, the gene is F8. In one embodiment, the method includes correcting a mutated F8 gene, thereby treating or preventing hemophilia A.

In one embodiment, the disease is a metabolic disease, e.g., mucopolysaccharidosis type I. In one embodiment, the gene contains a mutation that causes the metabolic disease. While not wishing to be bound by theory, it is believed that, In one embodiment, knockin or correction of the gene can ameliorate or cure the metabolic disease. In one embodiment, the gene is the IDUA gene. In one embodiment, the method includes knocking in a wild type IDUA gene or correcting a mutated IDUA gene, thereby treating or preventing mucopolysaccharidosis type I.

In one embodiment, the disease is an immunodeficiency, e.g., X-linked severe combined immunodeficiency. In one embodiment, the gene contains a mutation that causes the immunodeficiency. While not wishing to be bound by theory, it is believed that, In one embodiment, knockin or correction of the gene can ameliorate or cure the disease. In one embodiment, the gene is the IL2RG gene. In one embodiment, the method includes knocking a wild type IL2RG gene or correcting a mutated IL2RG gene, thereby treating or preventing X-linked severe combined immunodeficiency.

In one embodiment, the disease is a myeloid immunodeficiency, e.g., chronic granulomatous disease. In one embodiment, the gene contains a mutation that causes the myeloid immunodeficiency. While not wishing to be bound by theory, it is believed that, In one embodiment, knockin or correction of the gene can ameliorate or cure the disease. In one embodiment, the gene is the NCF1 gene. In one embodiment, the method includes knocking in a wild type NCF1 gene or correcting a mutated NCF1 gene, thereby treating or preventing chronic granulomatous disease.

In one embodiment, the disease a beta-lymphoid or immunoglobulin deficiency, e.g., X-linked agammaglobulinemia. In one embodiment, the gene contains a mutation that is associated with the beta-lymphoid or immunoglobulin deficiency. While not wishing to be bound by theory, it is believed that, In one embodiment, knockin or correction of the gene can ameliorate or cure the disease. In one embodiment, the gene is the BTK gene. In one embodiment, the method includes knocking in a wild type BTK gene or correcting a mutated BTK gene, thereby treating or preventing X-linked agammaglobulinemia.

In one embodiment, the disease is a cytopenia disorder, e.g., congenital amegakaryoctytic thrombocytopenia type I. In one embodiment, the gene contains a mutation associated with the cytopenia disorder. While not wishing to be bound by theory, it is believed that, In one embodiment, knockin or correction of the gene can ameliorate or cure the disease. In one embodiment, the gene is the MPL gene. In one embodiment, the method includes knocking in a wild type MPL gene or correcting a mutated MPL gene, thereby treating or preventing congenital amegakaryoctytic thrombocytopenia type I.

In one embodiment, the disease is a metabolic disease, an enzyme deficiency, a trafficking disorder, or a storage disease, e.g., mucopolysaccharoidosis type IIIA. In one embodiment, the gene contains a mutation associated with the metabolic disease, enzyme deficiency, trafficking disorder, or storage disease. While not wishing to be bound by theory, it is believed that, In one embodiment, knockin or correction of the gene can ameliorate or cure the disease. In one embodiment, the gene is the SGSH gene. In one embodiment, the method includes knocking in a wild type SGSH gene or correcting a mutated SGSH gene, thereby treating or preventing mucopolysaccharoidosis type IIIA.

In one embodiment, the disease is an erythroid disease, e.g., a primary familial and congenital polycythemia. In one embodiment, the gene contains a mutation associated the erythroid disease. While not wishing to be bound by theory, it is believed that, In one embodiment, knockin or correction of the gene can ameliorate or cure the disease. In one embodiment, the gene is the EPOR gene. In one embodiment, the method includes knocking down the EPOR gene, either transiently or permanently, thereby treating or preventing the primary familial and congenital polycythemia.

In one embodiment, the disease is an erythroid disease, e.g., a primary familial and congenital polycythemia. In one embodiment, the gene contains a mutation associated the erythroid disease. While not wishing to be bound by theory, it is believed that, In one embodiment, knockin or correction of the gene can ameliorate or cure the disease. In one embodiment, the gene is the EPOR gene. In one embodiment, the method includes knocking out or knocking down the EPOR gene, thereby treating or preventing the primary familial and congenital polycythemia.

Table 4 describes exemplary diseases that can be treated or prevented by the methods described herein and exemplary genes that can be altered by the methods described herein.

TABLE 4

| Disease | Gene |
|---|---|
| Hemoglobinopathies | |
| Sickle Cell Disease | HBB |
| Sickle Cell Disease | BCL11a |
| Beta Thalassemia | HBB |
| Beta Thalassemia | BCL11a |
| Alpha Thalassemia | HBA1 |
| Alpha Thalassemia | HBA2 |
| X-linked alpha-thalassemia | ATRX |
| Anemias | |
| Blackfan-Diamond syndrome | RPS19 |
| Fanconi anemia | FANCA, FANCB, FANCC, FANCD1, FANCD2, FANCE, FANCF, FANCG, FANCI, FANCJ, FANCL, FANCM, FANCN, FANCP, RAD51C |
| Hemolytic anemia due to red cell pyruvate kinase deficiency | PKLR |
| Aplastic anemia | IFNG |
| Congenital dyserythropoietic anemia type 2 | SEC23B |
| Hereditary spherocytosis | ANK1 |
| Hereditary spherocytosis | SPTB |
| Hereditary spherocytosis | SPTA |
| Hereditary spherocytosis | SLC4A1 |
| Hereditary spherocytosis | EPB42 |
| Anemia | EPO |
| Neutropenia | CSF2 |
| Neutropenia | CSF3 |
| Disorders of Hemostasis | |
| Von Willebrand Disease | VWF |
| Hemophilia | F7 |
| Hemophilia A | F8 |
| Hemophilia B | F9 |
| Disorder of Hemostasis | F2 |
| Parahemophilia | F5 |
| Bleeding Tendancy | F7 |
| Factor X Deficiency | F10 |
| Disorder of Hemostasis, clotting disorder | F11 |
| Disorder of Hemostasis | F12 |
| Factor XIII deficiency | F13A1 |
| Factor XIII deficiency | F13B |
| Disorder of Hemostasis | PROC |
| Disorder of Hemostasis | PROS1 |
| Thrombosis | SERPINC1 |
| Fibrinogen deficiency/Hypofibrinoginemia | FGA, FGB, FGG |
| Disorder of Hemostasis | PROZ |
| Plasminogen deficiency | PLG |
| Disorder of Hemostasis, cardiovascular disease | PLAT |
| Disorder of Hemostasis, cardiovascular disease | PLAU |
| Disorder of Hemostasis | F3 |
| Disorder of Hemostasis | TFPI |
| Disorder of Hemostasis | PAI |
| Thrombophilia due to heparin cofactor II deficiency | HCF2 |
| Metabolic Diseases | |
| Mucopolysaccharidoses | |
| MPS I- Hurler's | IDUA |
| MPS II- Hunter's | IDS |
| MPS-IVA | GALNS |
| MPS-VI | ARSB |
| MPS IIIA | SGSH |
| MPSIIIB- Sanfilippo B Syndrome | NAGLU |
| MPSIIIC | HGSNAT |
| MPS IV | GALNS |
| Severe Immunodeficiencies | |
| X-linked Severe Combined Immunodeficiency | IL2RG |
| ADA Severe Combined Immunodeficiency | ADA |
| IL7-RA Severe Combined Immunodeficiency | IL7R |
| CD3 Severe Combined Immunodeficiency | CD247 |
| RAG1 Severe Combined Immunodeficiency | RAG1 |
| RAG2 Severe Combined Immunodeficiency | RAG2 |
| Artemis Severe Combined Immunodeficiency | DCLRE1C |

TABLE 4-continued

| Disease | Gene |
|---|---|
| CD45 Severe Combined Immunodeficiency | PTPRC |
| Jak3 Severe Combined Immunodeficiency | JAK3 |
| Cartilage-hair hypoplasia syndrome | RMRP |
| IPEX X-linked Immunodysregulation, polyendocrinopathy, and enteropathy | FOXP3 |
| IPEX-like syndrome | STAT1 |
| Common variable immunodeficiency 1 | ICOS |
| Common variable immunodeficiency 2 | TNFRSF13B |
| Common variable immunodeficiency 3 | CD19 |
| Common variable immunodeficiency 4 | TNFRSF13C |
| Common variable immunodeficiency 5 | CD20 |
| Common variable immunodeficiency 6 | CD81 |
| HIV | CCR5 |
| HIV | CXCR4 |
| Bare lymphocyte Syndrome type II, complementation group E | RFX5 |
| Bare lymphocyte Syndrome type II, complementation group C | RFX5 |
| Bare lymphocyte Syndrome type II, complementation group D | RFXAP |
| Bare lymphocyte Syndrome type II, complementation group A | MHC2TA |
| Bare lymphocyte Syndrome type II | RFXB |
| Bare lymphocyte Syndrome type I | TAP1 |
| Bare lymphocyte Syndrome type I | TAP2 |
| Bare lymphocyte Syndrome type I | TAPBP |
| Myeloid Immunodeficiencies | |
| Congenital agranulocytosis | VPS45 |
| Congenital agranulocytosis | HAX1 |
| Congenital agranulocytosis | ELANE |
| Chronic granulomatous disease | NCF1 |
| Chronic granulomatous disease | CYBB |
| Chronic granulomatous disease | CYBA |
| Chronic granulomatous disease | NCF2 |
| Chronic granulomatous disease | NCF4 |
| Familial hemophagocytic lymphohistiocytosis type 2 | PRF1, HPLH |
| Wiskott-Aldrich syndrome | WAS |
| Chediak-Higashi syndrome | LYST |
| Reticular dysgenesis | AK2 |
| B-lymphoid and Immunoglobulin immunodeficiencies | |
| X-Linked Agammaglobulinemia | BTK |
| X linked hyperimmunoglobulin M | TNFSF5 |
| Hyper IgM type 2 | AICDA |
| Hyper IgM type 3 | CD40 |
| Hyper IgM type 5 | UNG |
| Cytopenia Disorders (with neurologic complications) | |
| Gaucher's disease | GBA |
| Congenital amegakaryocytic thrombocytopenia type I | MPL |
| Metabolic, Enzyme Deficiency, Trafficking, and Storage Diseases | |
| Alpha-mannosidosis | MAN2B1 |
| Lysosomal acid lipase deficiency | LIPA |
| Glycogen Storage Disease 0 | GYS2 |
| Glycogen Storage Disease 1A | G6PC |
| Glycogen Storage Disease 1B | G6PT1/SLC37A4 |
| Glycogen Storage Disease II/Pompe | GAA |
| Glycogen Storage Disease III | AGL |
| Glycogen Storage Disease IV | GBE1 |
| Glycogen Storage Disease V | PYGM |
| Glycogen Storage Disease VI | PYGL |
| Glycogen Storage Disease VII | PFKM |
| Glycogen Storage Disease 9a | PHKA2 |
| Glycogen Storage Disease 9b | PHKB |
| Glycogen Storage Disease X | PGAM2 |
| Growth failure, growth abnormalities | GH1 |
| Thyroid disorders | TG |
| Diabetes and disorders of metabolism | INS |
| Diabetes and disorders of metabolism | GCG |
| Friedrich's Ataxia | FXN |
| Metabolic disease; cholesterol disorder | LCAT |
| Metabolic disease; lipoprotein disorder | APOA1 |
| Primary IGF-1 deficiency | IGF1 |
| Aspartylglucosaminuria | AGA |
| Gout | UOX |
| Mucopolysaccharidoses | |
| MPS I- Hurler's | IDUA |
| MPS II- Hunter's | IDS |
| MPS-IVA | GALNS |
| MPS-VI | ARSB |
| MPS IIIA | SGSH |

TABLE 4-continued

| Disease | Gene |
|---|---|
| MPSIIIB- Sanfilippo B Syndrome | NAGLU |
| Metachromatic leukodystrophy | ARSA |
| Adrenoleukodystrophy | ABCD1 |
| Fabry's disease | GLA |
| Lesch-Nyhan syndrome | HPRT |
| Adenosine deaminase deficiency- ADA | ADA |
| Krabbe Disease | GALC |
| Farber disease | ASAH1 |
| neuronal ceroid lipofuscinosis (NCL) 1 | PPT1 |
| neuronal ceroid lipofuscinosis (NCL) 2 | TPP1 |
| niemann pick type C1 | NPC1 |
| Niemann-Pick type C2 | NPC2 protein |
| Niemann-Pick type A | SMPD1 |
| Niemann-Pick type B | SMPD1 |
| Erythroid Diseases | |
| Polycythemia Vera | JAK2 |
| Polycythemia Vera | TET2 |
| Primary familial and congenital polycythemias (PFCPs) | EPOR |
| Cancer- Metastatic growth | EPOR |
| Paroxysmal nocturnal hemoglobinuria | PIGA |
| Autoimmune disease; inflammatory disease; infectious disease; oncologic disease | |
| Autoimmune disease; inflammatory disease; infectious disease | C5 |
| Autoimmune disease; inflammatory disease; infectious disease | C3 |
| Autoimmune disease; inflammatory disease; GVHD, acute organ rejection | IL6 |
| Autoimmune disease; inflammatory disease; infectious disease, oncologic disease | IL1A, IL1B |
| Autoimmune disease; inflammatory disease; infectious disease, oncologic disease | IL2 |
| Autoimmune disease; inflammatory disease; infectious disease, oncologic disease | IL3 |
| Autoimmune disease; inflammatory disease; infectious disease, oncologic disease | IL7 |
| Autoimmune disease; inflammatory disease; infectious disease, oncologic disease | IL9 |
| Autoimmune disease; inflammatory disease; infectious disease, oncologic disease | IL12 |
| Autoimmune disease; inflammatory disease; infectious disease, oncologic disease | IL17 |
| Autoimmune disease; inflammatory disease; infectious disease, oncologic disease | IL18 |
| Autoimmune disease; inflammatory disease; infectious disease, oncologic disease | IL4 |
| Autoimmune disease; inflammatory disease; infectious disease, oncologic disease | IL10 |
| Autoimmune disease; inflammatory disease; infectious disease, oncologic disease | IL11 |
| Autoimmune disease; inflammatory disease; infectious disease, oncologic disease | IL35 |
| Autoimmune disease; inflammatory disease; infectious disease, oncologic disease | IL26 |
| Autoimmune disease; inflammatory disease; infectious disease, oncologic disease | IL13 |
| Autoimmune disease; inflammatory disease; infectious disease, oncologic disease | IL23 |
| Autoimmune disease; inflammatory disease; infectious disease, oncologic disease | IL27 |
| Autoimmune disease; inflammatory disease; infectious disease, oncologic disease | IFNG |
| Autoimmune disease; inflammatory disease; infectious disease, oncologic disease | CXCL1 |
| Autoimmune disease; inflammatory disease; infectious disease, oncologic disease | CXCL2 |
| Autoimmune disease; inflammatory disease; infectious disease, oncologic disease | CXCL3 |
| Autoimmune disease; inflammatory disease; infectious disease, oncologic disease | CXCL4 |
| Autoimmune disease; inflammatory disease; infectious disease, oncologic disease | CXCL5 |
| Autoimmune disease; inflammatory disease; infectious disease, oncologic disease | CXCL6 |
| Autoimmune disease; inflammatory disease; infectious disease, oncologic disease | CXCL7 |
| Autoimmune disease; inflammatory disease; infectious disease, oncologic disease | CXCL8 |
| Autoimmune disease; inflammatory disease; infectious disease, oncologic disease | CXCL9 |
| Autoimmune disease; inflammatory disease; infectious disease, oncologic disease | CXCL10 |
| Autoimmune disease; inflammatory disease; infectious disease, oncologic disease | CXCL11 |
| Autoimmune disease; inflammatory disease; infectious disease, oncologic disease | CXCL12 |
| Autoimmune disease; inflammatory disease; infectious disease, oncologic disease | CXCL13 |
| Autoimmune disease; inflammatory disease; infectious disease, oncologic disease | CXCL14 |
| Autoimmune disease; inflammatory disease; infectious disease, oncologic disease | CXCL15 |
| Autoimmune disease; inflammatory disease; infectious disease, oncologic disease | CXCL16 |
| Autoimmune disease; inflammatory disease; infectious disease, oncologic disease | CCL1 |
| Autoimmune disease; inflammatory disease; infectious disease, oncologic disease | CCL2 |
| Autoimmune disease; inflammatory disease; infectious disease, oncologic disease | CCL3 |
| Autoimmune disease; inflammatory disease; infectious disease, oncologic disease | CCL4 |
| Autoimmune disease; inflammatory disease; infectious disease, oncologic disease | CCL5 |
| Autoimmune disease; inflammatory disease; infectious disease, oncologic disease | CCL6 |
| Autoimmune disease; inflammatory disease; infectious disease, oncologic disease | CCL7 |
| Autoimmune disease; inflammatory disease; infectious disease, oncologic disease | CCL8 |
| Autoimmune disease; inflammatory disease; infectious diseases, oncologic disease | CCL9 |
| Autoimmune disease; inflammatory disease; infectious disease, oncologic disease | CCL10 |
| Autoimmune disease; inflammatory disease; infectious disease, oncologic disease | CCL11 |
| Autoimmune disease; inflammatory disease; infectious disease, oncologic disease | CCL12 |
| Autoimmune disease; inflammatory disease; infectious disease, oncologic disease | CCL13 |
| Autoimmune disease; inflammatory disease; infectious disease, oncologic disease | CCL14 |
| Autoimmune disease; inflammatory disease; infectious disease, oncologic disease | CCL15 |
| Autoimmune disease; inflammatory disease; infectious disease, oncologic disease | CCL16 |
| Autoimmune disease; inflammatory disease; infectious disease, oncologic disease | CCL17 |
| Autoimmune disease; inflammatory disease; infectious disease, oncologic disease | CCL18 |
| Autoimmune disease; inflammatory disease; infectious disease, oncologic disease | CCL19 |

TABLE 4-continued

| Disease | Gene |
|---|---|
| Autoimmune disease; inflammatory disease; infectious disease, oncologic disease | CCL20 |
| Autoimmune disease; inflammatory disease; infectious disease, oncologic disease | CCL21 |
| Autoimmune disease; inflammatory disease; infectious disease, oncologic disease | CCL22 |
| Autoimmune disease; inflammatory disease; infectious disease, oncologic disease | CCL23 |
| Autoimmune disease; inflammatory disease; infectious disease, oncologic disease | CCL24 |
| Autoimmune disease; inflammatory disease; infectious disease, oncologic disease | CCL25 |
| Autoimmune disease; inflammatory disease; infectious disease, oncologic disease | CCL26 |
| Autoimmune disease; inflammatory disease; infectious disease, oncologic disease | CCL27 |
| Autoimmune disease; inflammatory disease; infectious disease, oncologic disease | CCL28 |
| Autoimmune disease; inflammatory disease; infectious disease, oncologic disease | XCL1 |
| Autoimmune disease; inflammatory disease; infectious disease, oncologic disease | XCL2 |
| Autoimmune disease; inflammatory disease; infectious disease, oncologic disease | CX3CL1 |
| Autoimmune disease; inflammatory disease; infectious disease, oncologic disease | CXCR1 |
| Autoimmune disease; inflammatory disease; infectious disease, oncologic disease | CXCR2 |
| Autoimmune disease; inflammatory disease; infectious disease, oncologic disease | CXCR3 |
| Autoimmune disease; inflammatory disease; infectious disease, oncologic disease | CXCR4 |
| Autoimmune disease; inflammatory disease; infectious disease, oncologic disease | CXCR5 |
| Autoimmune disease; inflammatory disease; infectious disease, oncologic disease | CCR1 |
| Autoimmune disease; inflammatory disease; infectious disease, oncologic disease | CCR2 |
| Autoimmune disease; inflammatory disease; infectious disease, oncologic disease | CCR3 |
| Autoimmune disease; inflammatory disease; infectious disease, oncologic disease | CCR4 |
| Autoimmune disease; inflammatory disease; infectious disease, oncologic disease | CCR5 |
| Autoimmune disease; inflammatory disease; infectious disease, oncologic disease | CCR6 |
| Autoimmune disease; inflammatory disease; infectious disease, oncologic disease | CCR7 |
| Autoimmune disease; inflammatory disease; infectious disease, oncologic disease | CCR8 |
| Autoimmune disease; inflammatory disease; infectious disease, oncologic disease | CCR9 |
| Autoimmune disease; inflammatory disease; infectious disease, oncologic disease | CCR10 |
| Autoimmune disease; inflammatory disease; infectious disease, oncologic disease | CCR11 |
| Autoimmune disease; inflammatory disease; infectious disease, oncologic disease | CX3CR1 |
| Autoimmune disease; inflammatory disease; infectious disease, oncologic disease | DARC |
| Hereditary Angioedema | C1INH |
| Inflammatory, Rheumatoid, Oncologic Disease | EGF |
| Inflammatory, Rheumatoid, Oncologic Disease | VEGF |
| Multiple sclerosis | IFNA1, IFNA2, IFNB1 |
| Autoimmune disease; Rheumatoid Arthritis | TNF |
| lymphoma | ABL1 |
| lymphoma | BCL2 |
| lymphoma | BCL11A |
| lymphoma | BCL11B |
| lymphoma | BCR |
| lymphoma | BMI1 |
| lymphoma | BRD2 |
| lymphoma | CCND1 |
| lymphoma | CCND2 |
| lymphoma | CDX2 |
| lymphoma | ETV6 |
| lymphoma | JAK2 |
| lymphoma | JUND |
| lymphoma | KLF6 |
| lymphoma | LCK |
| lymphoma | LMO1 |
| lymphoma | LMO2 |
| lymphoma | LYL1 |
| lymphoma | MLL |
| lymphoma | MLLT10 |
| lymphoma | MTCP1 |
| lymphoma | MYC |
| lymphoma | NFKB2 |
| lymphoma | NOTCH1 |
| lymphoma | NUP98 |
| lymphoma | OLIG2 |
| lymphoma | PBX1 |
| lymphoma | PICALM |
| lymphoma | RAP1GDS1 |
| lymphoma | RUNX1 |
| lymphoma | STIL |
| lymphoma | TAL1 |
| lymphoma | TAL2 |
| lymphoma | NKAIN2 |
| lymphoma | TCF3 |
| lymphoma | TCL1A |
| lymphoma | TLX1 |
| lymphoma | TLX3 |
| Oncologic disease/Cancer | FAS |
| Oncologic disease/Cancer | BID |
| Oncologic disease/Cancer | CD152 |
| Oncologic disease/Cancer | PCDCD1 |

TABLE 4-continued

| Disease | Gene |
| --- | --- |
| Oncologic disease/Cancer | CBLB |
| Oncologic disease/Cancer | PTPN6 |
| Oncologic disease/Cancer | CD19 |
| Oncologic disease/Cancer | PARP1 |
| Oncologic disease/Cancer | CD223 |
| Oncologic disease/Cancer | CD272 |
| Oncologic disease/Cancer | CD200R1 |
| Oncologic disease/Cancer | TIGIT |
| Oncologic disease/Cancer | LAIR1 |
| Oncologic disease/Cancer | PTGER2 |
| Oncologic disease/Cancer | PTGER4 |
| Oncologic disease/Cancer | CD16 |
| Oncologic disease/Cancer | PDCD1 |
| Oncologic disease/Cancer | HAVCR2 |
| Oncologic disease/Cancer | CD40 |
| Oncologic disease/Cancer | WAS |
| Oncologic disease/Cancer; Leukemia | WT1 |
| Oncologic disease/Cancer; Leukemia | CHK1 |

In one embodiment, the treatment is initiated in a subject after onset of the disease. In one embodiment, the treatment is initiated in a subject after onset of the disease, but early in the course of disease progression (e.g., prior to the development of certain symptoms), e.g., to prevent progression of the disease. In one embodiment, the method comprises initiating treatment of a subject in an advanced stage of disease, e.g., to slow progression of the disease.

In one embodiment, a method described herein is used to treat a subject having a disease described herein. In one embodiment, a method described herein is used to prevent, or delay the onset or progression of, a disease described herein.

In one embodiment, a method described herein results in a selective advantage to survival of one or more of modified cells. In one embodiment, the stem cell is modified and has a gene knockout, knockin, knockdown or correction. Diseased cells that are not modified may undergo apoptosis. Thus, In one embodiment, after the treatment described herein, modified cells survive, while unmodified cells die. This selective advantage can drive eventual colonization in cells with at least 50%, e.g., at least 60%, 70%, 80%, 81%, 82%, 83%, 84%, 85%, 86%, 87%, 88%, 89%, 89%, 90%, 91%, 92%, 93%, 94%, 95%, 96%, 97%, 98%, 99%, or 100% modified cells.

In one embodiment, the method comprises initiating treatment in a subject who undergoes genetic testing which finds a mutation in a gene, e.g., a gene described herein.

In one embodiment, the method comprises initiating treatment in a subject who tests positive for a disease described herein.

In one embodiment, the method comprises initiating treatment in a subject with a family history of the disease who demonstrates any of the symptoms or signs of the disease and/or has been found to have a mutation in a gene associated the disease.

In one embodiment, the method comprises treating a subject at the appearance of a symptom consistent or associated with the disease.

In one embodiment, the method includes isolating a cell from a subject. In one embodiment, a cell is altered ex vivo and returned (e.g., transplanted) to a subject. In one embodiment, the subject is the same subject from whom the cell is isolated. In another embodiment, the subject is different from the subject from whom the cell is isolated. In one embodiment, an autologous stem/progenitor cell is altered ex vivo and returned to the subject. In another embodiment, a heterologous stem/progenitor cell is altered ex vivo and returned into the subject.

In one embodiment, the treatment comprises delivery of a gRNA molecule, a Cas9 molecule, and optionally, a donor template nucleic acid, to a cell described herein. In one embodiment, the gRNA molecule, the Cas9 molecule, or both, and optionally the template nucleic acid, are delivered by a viral vector, e.g., an AAV vector or lentivirus vector, e.g., integration deficient lentivirus (IDLV). In another embodiment, the gRNA molecule and the Cas9 molecule are delivered as a gRNA molecule/Cas9 molecule ribonucleoprotein complex. In another embodiment, the gRNA molecule and the Cas9 molecule are delivered as RNA. In one embodiment, the template nucleic acid comprises at least one exon of the target gene. In one embodiment, the template nucleic acid does not contain the mutation associated with the disease. In one embodiment, the template nucleic acid comprises a promoter sequence. In another embodiment, the template nucleic acid does not comprise a promoter sequence. In one embodiment, the template nucleic acid comprises a splice donor or acceptor. In another embodiment, the template nucleic acid comprises a polyadenylation signal.

Methods of Repairing Mutation(s) in a Gene

Disclosed herein are methods for altering a target position (e.g., a target mutant position) in a gene, e.g., a gene described herein. Altering the target position can be achieved, e.g., by repairing (e.g., correcting) one or more mutations in the gene, e.g., by HDR. In this approach, mutant allele(s) are corrected and restored to wild type state. While not wishing to be bound by theory, it is believed that, In one embodiment, correction of a mutation in the gene described herein restores wild type gene activity. The method described herein can be performed in all cell types, e.g., a cell type described herein.

Methods of Knocking Out or Knocking Down a Gene

Disclosed herein are methods for altering a target position (e.g., a target knockout position or a target knockdown position) in a gene, e.g., a gene described herein. Altering the target position can be achieved, e.g., by: (1) knocking out the gene: (a) insertion or deletion (e.g., NHEJ-mediated insertion or deletion) of one or more nucleotides in close proximity to or within the early coding region of the gene, or (b) deletion (e.g., NHEJ-mediated deletion) of a genomic sequence including at least a portion of the gene, or (2)

knocking down the gene mediated by enzymatically inactive Cas9 (eiCas9) molecule or an eiCas9-fusion protein (e.g., fused to a transcriptional repressor) by targeting the promoter region of the gene.

All approaches give rise to alteration of the gene. The method described herein can be performed in all cell types, e.g., a cell type described herein.

Methods of Knocking in a Gene Sequence

Disclosed herein are methods for altering a target position (e.g., a target knockin position) in a gene, e.g., a gene described herein. Altering the target position can be achieved, e.g., by knocking in a gene sequence, e.g., a gene sequence described herein (e.g., a cDNA encoding at least a portion of the gene described herein), e.g., by HDR. While not wishing to be bound by theory, it is believed that, In one embodiment, knockin a gene sequence described herein restores wild type gene activity. The method described herein can be performed in all cell types, e.g., a cell type described herein.

Methods of Activating a Gene

Disclosed herein are methods for activating in a gene, e.g., a gene described herein. Activation of a gene can be mediated by enzymatically inactive Cas9 (eiCas9) molecule or an eiCas9-fusion protein (e.g., fused to a transcriptional activator) by targeting the promoter region of the gene. While not wishing to be bound by theory, it is believed that, In one embodiment, activating a gene described herein restores wild type gene activity. The method described herein can be performed in all cell types, e.g., a cell type described herein.

Multiplexing Alteration of Two or More Genes

The alteration, of two or more genes in the same cell or cells is referred to herein as "multiplexing". Multiplexing constitutes the modification of at least two genes in the same cell or cells.

For example, when two or more genes (e.g., CCR5 and CXCR4) are targeted for alteration, the two or more genes (e.g., CCR5 and CXCR4) may be altered sequentially or simultaneously. In one embodiment the alteration of the CXCR4 gene is prior to the alteration of the CCR5 gene. In one embodiment the alteration of the CXCR4 gene is concurrent with the alteration of the CCR5 gene. In one embodiment the alteration of the CXCR4 gene is subsequent to the alteration of the CCR5 gene. In one embodiment, the effect of the alterations is synergistic. In one embodiment, the two or more genes (e.g., CCR5 and CXCR4) are altered sequentially in order reduce the probability of introducing genomic rearrangements (e.g., translocations) involving the two target positions.

II. Guide RNA (gRNA) Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule) (e.g., chimeric or modular (comprising more than one, and typically two, separate RNA molecules). The gRNA molecules provided herein comprise a targeting domain comprising, consisting of, or consisting essentially of a nucleic acid sequence fully or partially complementary to a target domain. In certain embodiments, the gRNA molecule further comprises one or more additional domains, including for example a first complementarity domain, a linking domain, a second complementarity domain, a proximal domain, a tail domain, and a 5' extension domain. Each of these domains is discussed in detail below. Additional details on gRNAs are provided in Section I entitled "gRNA molecules" of PCT Application WO 2015/048577, the entire contents of which are expressly incorporated herein by reference. In certain embodiments, one or more of the domains in the gRNA molecule comprises an amino acid sequence identical to or sharing sequence homology with a naturally occurring sequence, e.g., from S. pyogenes, S. aureus, or S. thermophilus.

In certain embodiments, a unimolecular, or chimeric, gRNA comprises, preferably from 5' to 3': a targeting domain complementary to a target domain in a gene, e.g., a gene described herein; a first complementarity domain; a linking domain; a second complementarity domain (which is complementary to the first complementarity domain); a proximal domain; and optionally, a tail domain.

In certain embodiments, a modular gRNA comprises: a first strand comprising, preferably from 5' to 3': a targeting domain (which is complementary to a target domain in a gene; and a first complementarity domain; and a second strand, comprising, preferably from 5' to 3': optionally, a 5' extension domain; a second complementarity domain; a proximal domain; and optionally, a tail domain.

Each of these domains are described in more detail, below.

Targeting Domain

The targeting domain (sometimes referred to alternatively as the guide sequence or complementarity region) comprises, consists of, or consists essentially of a nucleic acid sequence that is complementary or partially complementary to a target nucleic acid sequence, e.g., a target nucleic acid sequence in a target gene. The nucleic acid sequence in a target gene, e.g., HBB, to which all or a portion of the targeting domain is complementary or partially complementary is referred to herein as the target domain. In certain embodiments, the target domain comprises a target position within the target gene, e.g., HBB. In other embodiments, a target position lies outside (i.e., upstream or downstream of) the target domain. In certain embodiments, the target domain is located entirely within a target gene, e.g., in a coding region, an intron, or an exon. In other embodiments, all or part of the target domain is located outside of a target gene, e.g., in a control region or in a non-coding region.

Methods for selecting targeting domains are known in the art (see, e.g., Fu 2014; Sternberg 2014).

The strand of the target nucleic acid comprising the target domain is referred to herein as the "complementary strand" because it is complementary to the targeting domain sequence. Since the targeting domain is part of a gRNA molecule, it comprises the base uracil (U) rather than thymine (T); conversely, any DNA molecule encoding the gRNA molecule will comprise thymine rather than uracil. In a targeting domain/target domain pair, the uracil bases in the targeting domain will pair with the adenine bases in the target domain. In certain embodiments, the degree of complementarity between the targeting domain and target domain is sufficient to allow targeting of a Cas9 molecule to the target nucleic acid.

In certain embodiments, the targeting domain comprises a core domain and an optional secondary domain. In certain of these embodiments, the core domain is located 3' to the secondary domain, and in certain of these embodiments the core domain is located at or near the 3' end of the targeting domain. In certain of these embodiments, the core domain consists of or consists essentially of about 8 to about 13 nucleotides at the 3' end of the targeting domain. In certain embodiments, only the core domain is complementary or partially complementary to the corresponding portion of the target domain, and in certain of these embodiments the core domain is fully complementary to the corresponding portion of the target domain. In other embodiments, the secondary domain is also complementary or partially complementary to a portion of the target domain. In certain embodiments, the core domain is complementary or partially complementary to a core domain target in the target domain, while the secondary domain is complementary or partially complementary to a secondary domain target in the target domain. In certain embodiments, the core domain and secondary domain have the same degree of complementarity with their respective corresponding portions of the target domain. In other embodiments, the degree of complementarity between the core domain and its target and the degree of complementarity between the secondary domain and its target may differ. In certain of these embodiments, the core domain may have a higher degree of complementarity for its target than the secondary domain, whereas in other embodiments the secondary domain may have a higher degree of complementarity than the core domain.

In certain embodiments, the targeting domain and/or the core domain within the targeting domain is 3 to 100, 5 to 100, 10 to 100, or 20 to 100 nucleotides in length, and in certain of these embodiments the targeting domain or core domain is 3 to 15, 3 to 20, 5 to 20, 10 to 20, 15 to 20, 5 to 50, 10 to 50, or 20 to 50 nucleotides in length. In certain embodiments, the targeting domain and/or the core domain within the targeting domain is 6, 7, 8, 9, 10, 11, 12, 13, 14, 15, 16, 17, 18, 19, 20, 21, 22, 23, 24, 25, or 26 nucleotides in length. In certain embodiments, the targeting domain and/or the core domain within the targeting domain is 6+/−2, 7+/−2, 8+/−2, 9+/−2, 10+/−2, 10+/−4, 10+/−5, 11+/−2, 12+/−2, 13+/−2, 14+/−2, 15+/−2, or 16+−2, 20+/−5, 30+/−5, 40+/−5, 50+/−5, 60+/−5, 70+/−5, 80+/−5, 90+/−5, or 100+/−5 nucleotides in length.

In certain embodiments wherein the targeting domain includes a core domain, the core domain is 3 to 20 nucleotides in length, and in certain of these embodiments the core domain 5 to 15 or 8 to 13 nucleotides in length. In certain embodiments wherein the targeting domain includes a secondary domain, the secondary domain is 0, 1, 2, 3, 4, 5, 6, 7, 8, 9, 10, 11, 12, 13, 14 or 15 nucleotides in length. In certain embodiments wherein the targeting domain comprises a core domain that is 8 to 13 nucleotides in length, the targeting domain is 26, 25, 24, 23, 22, 21, 20, 19, 18, 17, or 16 nucleotides in length, and the secondary domain is 13 to 18, 12 to 17, 11 to 16, 10 to 15, 9 to 14, 8 to 13, 7 to 12, 6 to 11, 5 to 10, 4 to 9, or 3 to 8 nucleotides in length, respectively.

In certain embodiments, the targeting domain is fully complementary to the target domain. Likewise, where the targeting domain comprises a core domain and/or a secondary domain, in certain embodiments one or both of the core domain and the secondary domain are fully complementary to the corresponding portions of the target domain. In other embodiments, the targeting domain is partially complementary to the target domain, and in certain of these embodiments where the targeting domain comprises a core domain and/or a secondary domain, one or both of the core domain and the secondary domain are partially complementary to the corresponding portions of the target domain. In certain of these embodiments, the nucleic acid sequence of the targeting domain, or the core domain or targeting domain within the targeting domain, is at least 80%, 85%, 90%, or 95% complementary to the target domain or to the corresponding portion of the target domain. In certain embodiments, the targeting domain and/or the core or secondary domains within the targeting domain include one or more nucleotides that are not complementary with the target domain or a portion thereof, and in certain of these embodiments the targeting domain and/or the core or secondary domains within the targeting domain include 1, 2, 3, 4, 5, 6, 7, or 8 nucleotides that are not complementary with the target domain. In certain embodiments, the core domain includes 1, 2, 3, 4, or 5 nucleotides that are not complementary with the corresponding portion of the target domain. In certain embodiments wherein the targeting domain includes one or more nucleotides that are not complementary with the target domain, one or more of said non-complementary nucleotides are located within five nucleotides of the 5' or 3' end of the targeting domain. In certain of these embodiments, the targeting domain includes 1, 2, 3, 4, or 5 nucleotides within five nucleotides of its 5' end, 3' end, or both its 5' and 3' ends that are not complementary to the target domain. In certain embodiments wherein the targeting domain includes two or more nucleotides that are not complementary to the target domain, two or more of said non-complementary nucleotides are adjacent to one another, and in certain of these embodiments the two or more consecutive non-complementary nucleotides are located within five nucleotides of the 5' or 3' end of the targeting domain. In other embodiments, the two or more consecutive non-complementary nucleotides are both located more than five nucleotides from the 5' and 3' ends of the targeting domain.

In one embodiment, the gRNA molecule is a modular gRNA molecule. In another embodiment, the gRNA molecule is a unimolecular or chimeric gRNA molecule.

In one embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence described herein. In one embodiment, the nucleic acid encodes a gRNA molecule comprising a targeting domain described herein.

In certain embodiments, the targeting domain comprises 16 nucleotides. In certain embodiments, the targeting domain comprises 17 nucleotides. In certain embodiments, the targeting domain comprises 18 nucleotides. In certain embodiments, the targeting domain comprises 19 nucleotides. In certain embodiments, the targeting domain comprises 20 nucleotides. In certain embodiments, the targeting domain comprises 21 nucleotides. In certain embodiments, the targeting domain comprises 22 nucleotides. In certain embodiments, the targeting domain comprises 23 nucleotides. In certain embodiments, the targeting domain comprises 24 nucleotides. In certain embodiments, the targeting domain comprises 25 nucleotides. In certain embodiments, the targeting domain comprises 26 nucleotides.

In certain embodiments, the targeting domain which is complementary with a gene is 16 nucleotides or more in length. In certain embodiments, the targeting domain is 16 nucleotides in length. In certain embodiments, the targeting domain is 17 nucleotides in length. In another embodiment, the targeting domain is 18 nucleotides in length. In still another embodiment, the targeting domain is 19 nucleotides in length. In still another embodiment, the targeting domain is 20 nucleotides in length. In still another embodiment, the targeting domain is 21 nucleotides in length. In still another embodiment, the targeting domain is 22 nucleotides in length. In still another embodiment, the targeting domain is 23 nucleotides in length. In still another embodiment, the targeting domain is 24 nucleotides in length. In still another embodiment, the targeting domain is 25 nucleotides in length. In still another embodiment, the targeting domain is 26 nucleotides in length.

In one embodiment, a nucleic acid encodes a modular gRNA molecule, e.g., one or more nucleic acids encode a modular gRNA molecule. In another embodiment, a nucleic acid encodes a chimeric gRNA molecule. The nucleic acid may encode a gRNA molecule, e.g., the first gRNA molecule, comprising a targeting domain comprising 16 nucleotides or more in length. In one embodiment, the nucleic acid encodes a gRNA molecule, e.g., the first gRNA molecule, comprising a targeting domain that is 16 nucleotides in length. In another embodiment, the nucleic acid encodes a gRNA molecule, e.g., the first gRNA molecule, comprising a targeting domain that is 17 nucleotides in length. In still another embodiment, the nucleic acid encodes a gRNA molecule, e.g., the first gRNA molecule, comprising a targeting domain that is 18 nucleotides in length. In still another embodiment, the nucleic acid encodes a gRNA molecule, e.g., the first gRNA molecule, comprising a targeting domain that is 19 nucleotides in length. In still another embodiment, the nucleic acid encodes a gRNA molecule, e.g., the first gRNA molecule, comprising a targeting domain that is 20 nucleotides in length. In still another embodiment, the nucleic acid encodes a gRNA molecule, e.g., the first gRNA molecule, comprising a targeting domain that is 21 nucleotides in length. In still another embodiment, the nucleic acid encodes a gRNA molecule, e.g., the first gRNA molecule, comprising a targeting domain that is 22 nucleotides in length. In still another embodiment, the nucleic acid encodes a gRNA molecule, e.g., the first gRNA molecule, comprising a targeting domain that is 23 nucleotides in length. In still another embodiment, the nucleic acid encodes a gRNA molecule, e.g., the first gRNA molecule, comprising a targeting domain that is 24 nucleotides in length. In still another embodiment, the nucleic acid encodes a gRNA molecule, e.g., the first gRNA molecule, comprising a targeting domain that is 25 nucleotides in length. In still another embodiment, the nucleic acid encodes a gRNA molecule, e.g., the first gRNA molecule, comprising a targeting domain that is 26 nucleotides in length.

In certain embodiments, the targeting domain, core domain, and/or secondary domain do not comprise any modifications. In other embodiments, the targeting domain, core domain, and/or secondary domain, or one or more nucleotides therein, have a modification, including but not limited to the modifications set forth below. In certain embodiments, one or more nucleotides of the targeting domain, core domain, and/or secondary domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the targeting domain, core domain, and/or secondary domain render the targeting domain and/or the gRNA comprising the targeting domain less susceptible to degradation or more bio-compatible, e.g., less immunogenic. In certain embodiments, the targeting domain and/or the core or secondary domains include 1, 2, 3, 4, 5, 6, 7, or 8 or more modifications, and in certain of these embodiments the targeting domain and/or core or secondary domains include 1, 2, 3, or 4 modifications within five nucleotides of their respective 5' ends and/or 1, 2, 3, or 4 modifications within five nucleotides of their respective 3' ends. In certain embodiments, the targeting domain and/or the core or secondary domains comprise modifications at two or more consecutive nucleotides.

In certain embodiments wherein the targeting domain includes core and secondary domains, the core and secondary domains contain the same number of modifications. In certain of these embodiments, both domains are free of modifications. In other embodiments, the core domain includes more modifications than the secondary domain, or vice versa.

In certain embodiments, modifications to one or more nucleotides in the targeting domain, including in the core or secondary domains, are selected to not interfere with targeting efficacy, which can be evaluated by testing a candidate modification using a system as set forth below. gRNAs having a candidate targeting domain having a selected length, sequence, degree of complementarity, or degree of modification can be evaluated using a system as set forth below. The candidate targeting domain can be placed, either alone or with one or more other candidate changes in a gRNA molecule/Cas9 molecule system known to be functional with a selected target, and evaluated.

In certain embodiments, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

First and Second Complementarity Domains

The first and second complementarity (sometimes referred to alternatively as the crRNA-derived hairpin sequence and tracrRNA-derived hairpin sequences, respectively) domains are fully or partially complementary to one another. In certain embodiments, the degree of complementarity is sufficient for the two domains to form a duplexed region under at least some physiological conditions. In certain embodiments, the degree of complementarity between the first and second complementarity domains, together with other properties of the gRNA, is sufficient to allow targeting of a Cas9 molecule to a target nucleic acid.

In certain embodiments the first and/or second complementarity domain includes one or more nucleotides that lack complementarity with the corresponding complementarity domain. In certain embodiments, the first and/or second complementarity domain includes 1, 2, 3, 4, 5, or 6 nucleotides that do not complement with the corresponding complementarity domain. For example, the second complementarity domain may contain 1, 2, 3, 4, 5, or 6 nucleotides that do not pair with corresponding nucleotides in the first complementarity domain. In certain embodiments, the nucleotides on the first or second complementarity domain that do not complement with the corresponding complementarity domain loop out from the duplex formed between the first and second complementarity domains. In certain of these embodiments, the unpaired loop-out is located on the second complementarity domain, and in certain of these embodiments the unpaired region begins 1, 2, 3, 4, 5, or 6 nucleotides from the 5' end of the second complementarity domain.

In certain embodiments, the first complementarity domain is 5 to 30, 5 to 25, 7 to 25, 5 to 24, 5 to 23, 7 to 22, 5 to 22, 5 to 21, 5 to 20, 7 to 18, 7 to 15, 9 to 16, or 10 to 14 nucleotides in length, and in certain of these embodiments the first complementarity domain is 5, 6, 7, 8, 9, 10, 11, 12, 13, 14, 15, 16, 17, 18, 19, 20, 21, 22, 23, 24, or 25 nucleotides in length. In certain embodiments, the second complementarity domain is 5 to 27, 7 to 27, 7 to 25, 5 to 24, 5 to 23, 5 to 22, 5 to 21, 7 to 20, 5 to 20, 7 to 18, 7 to 17, 9 to 16, or 10 to 14 nucleotides in length, and in certain of these embodiments the second complementarity domain is 5, 6, 7, 8, 9, 10, 11, 12, 13, 14, 15, 16, 17, 18, 19, 20, 21, 22, 23, 24, 25, or 26 nucleotides in length. In certain embodiments, the first and second complementarity domains are each independently 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length. In certain embodiments, the second complementarity domain is longer than the first complementarity domain, e.g., 2, 3, 4, 5, or 6 nucleotides longer.

In certain embodiments, the first and/or second complementarity domains each independently comprise three subdomains, which, in the 5' to 3' direction are: a 5' subdomain, a central subdomain, and a 3' subdomain. In certain embodiments, the 5' subdomain and 3' subdomain of the first complementarity domain are fully or partially complementary to the 3' subdomain and 5' subdomain, respectively, of the second complementarity domain.

In certain embodiments, the 5' subdomain of the first complementarity domain is 4 to 9 nucleotides in length, and in certain of these embodiments the 5' domain is 4, 5, 6, 7, 8, or 9 nucleotides in length. In certain embodiments, the 5' subdomain of the second complementarity domain is 3 to 25, 4 to 22, 4 to 18, or 4 to 10 nucleotides in length, and in certain of these embodiments the 5' domain is 3, 4, 5, 6, 7, 8, 9, 10, 11, 12, 13, 14, 15, 16, 17, 18, 19, 20, 21, 22, 23, 24, or 25 nucleotides in length. In certain embodiments, the central subdomain of the first complementarity domain is 1, 2, or 3 nucleotides in length. In certain embodiments, the central subdomain of the second complementarity domain is 1, 2, 3, 4, or 5 nucleotides in length. In certain embodiments, the 3' subdomain of the first complementarity domain is 3 to 25, 4 to 22, 4 to 18, or 4 to 10 nucleotides in length, and in certain of these embodiments the 3' subdomain is 3, 4, 5, 6, 7, 8, 9, 10, 11, 12, 13, 14, 15, 16, 17, 18, 19, 20, 21, 22, 23, 24, or 25 nucleotides in length. In certain embodiments, the 3' subdomain of the second complementarity domain is 4 to 9, e.g., 4, 5, 6, 7, 8 or 9 nucleotides in length.

The first and/or second complementarity domains can share homology with, or be derived from, naturally occurring or reference first and/or second complementarity domain. In certain of these embodiments, the first and/or second complementarity domains have at least 50%, 60%, 70%, 80%, 85%, 90%, or 95% homology with, or differ by no more than 1, 2, 3, 4, 5, or 6 nucleotides from, the naturally occurring or reference first and/or second complementarity domain. In certain of these embodiments, the first and/or second complementarity domains may have at least 50%, 60%, 70%, 80%, 85%, 90%, or 95% homology with homology with a first and/or second complementarity domain from *S. pyogenes* or *S. aureus*.

In certain embodiments, the first and/or second complementarity domains do not comprise any modifications. In other embodiments, the first and/or second complementarity domains or one or more nucleotides therein have a modification, including but not limited to a modification set forth below. In certain embodiments, one or more nucleotides of the first and/or second complementarity domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the first and/or second complementarity domain render the first and/or second complementarity domain and/or the gRNA comprising the first and/or second complementarity less susceptible to degradation or more bio-compatible, e.g., less immunogenic. In certain embodiments, the first and/or second complementarity domains each independently include 1, 2, 3, 4, 5, 6, 7, or 8 or more modifications, and in certain of these embodiments the first and/or second complementarity domains each independently include 1, 2, 3, or 4 modifications within five nucleotides of their respective 5' ends, 3' ends, or both their 5' and 3' ends. In other embodiments, the first and/or second complementarity domains each independently contain no modifications within five nucleotides of their respective 5' ends, 3' ends, or both their 5' and 3' ends. In certain embodiments, one or both of the first and second complementarity domains comprise modifications at two or more consecutive nucleotides.

In certain embodiments, modifications to one or more nucleotides in the first and/or second complementarity domains are selected to not interfere with targeting efficacy, which can be evaluated by testing a candidate modification in a system as set forth below. gRNAs having a candidate first or second complementarity domain having a selected length, sequence, degree of complementarity, or degree of modification can be evaluated in a system as set forth below. The candidate complementarity domain can be placed, either alone or with one or more other candidate changes in a gRNA molecule/Cas9 molecule system known to be functional with a selected target, and evaluated.

In certain embodiments, the duplexed region formed by the first and second complementarity domains is, for example, 6, 7, 8, 9, 10, 11, 12, 13, 14, 15, 16, 17, 18, 19, 20, 21, or 22 bp in length, excluding any looped out or unpaired nucleotides.

In certain embodiments, the first and second complementarity domains, when duplexed, comprise 11 paired nucleotides (see, for e.g., gRNA of SEQ ID NO:5). In certain embodiments, the first and second complementarity domains, when duplexed, comprise 15 paired nucleotides (see, e.g., gRNA of SEQ ID NO:27). In certain embodiments, the first and second complementarity domains, when duplexed, comprise 16 paired nucleotides (see, e.g., gRNA of SEQ ID NO:28). In certain embodiments, the first and second complementarity domains, when duplexed, comprise 21 paired nucleotides (see, e.g., gRNA of SEQ ID NO:29).

In certain embodiments, one or more nucleotides are exchanged between the first and second complementarity domains to remove poly-U tracts. For example, nucleotides 23 and 48 or nucleotides 26 and 45 of the gRNA of SEQ ID NO:5 may be exchanged to generate the gRNA of SEQ ID NOs:30 or 31, respectively. Similarly, nucleotides 23 and 39 of the gRNA of SEQ ID NO:29 may be exchanged with nucleotides 50 and 68 to generate the gRNA of SEQ ID NO:32.

Linking Domain

The linking domain is disposed between and serves to link the first and second complementarity domains in a unimolecular or chimeric gRNA. In certain embodiments, part of the linking domain is from a crRNA-derived region, and another part is from a tracrRNA-derived region.

In certain embodiments, the linking domain links the first and second complementarity domains covalently. In certain of these embodiments, the linking domain consists of or comprises a covalent bond. In other embodiments, the linking domain links the first and second complementarity domains non-covalently. In certain embodiments, the linking domain is ten or fewer nucleotides in length, e.g., 1, 2, 3, 4, 5, 6, 7, 8, 9, or 10 nucleotides. In other embodiments, the linking domain is greater than 10 nucleotides in length, e.g., 11, 12, 13, 14, 15, 16, 17, 18, 19, 20, 21, 22, 23, 24, or 25 or more nucleotides. In certain embodiments, the linking domain is 2 to 50, 2 to 40, 2 to 30, 2 to 20, 2 to 10, 2 to 5, 10 to 100, 10 to 90, 10 to 80, 10 to 70, 10 to 60, 10 to 50, 10 to 40, 10 to 30, 10 to 20, 10 to 15, 20 to 100, 20 to 90, 20 to 80, 20 to 70, 20 to 60, 20 to 50, 20 to 40, 20 to 30, or 20 to 25 nucleotides in length. In certain embodiments, the linking domain is 10+/−5, 20+/−5, 20+/−10, 30+/−5, 30+/−10, 40+/−5, 40+/−10, 50+/−5, 50+/−10, 60+/−5, 60+/−10, 70+/−5, 70+/−10, 80+/−5, 80+/−10, 90+/−5, 90+/−10, 100+/−5, or 100+/−10 nucleotides in length.

In certain embodiments, the linking domain shares homology with, or is derived from, a naturally occurring sequence, e.g., the sequence of a tracrRNA that is 5' to the second complementarity domain. In certain embodiments, the linking domain has at least 50%, 60%, 70%, 80%, 90%, or 95% homology with or differs by no more than 1, 2, 3, 4, 5, or 6 nucleotides from a linking domain disclosed herein.

In certain embodiments, the linking domain does not comprise any modifications. In other embodiments, the linking domain or one or more nucleotides therein have a modification, including but not limited to the modifications set forth below. In certain embodiments, one or more nucleotides of the linking domain may comprise a 2' modification (e.g., a modification at the 2' position on ribose), e.g., a 2-acetylation, e.g., a 2' methylation. In certain embodiments, the backbone of the linking domain can be modified with a phosphorothioate. In certain embodiments, modifications to one or more nucleotides of the linking domain render the linking domain and/or the gRNA comprising the linking domain less susceptible to degradation or more bio-compatible, e.g., less immunogenic. In certain embodiments, the linking domain includes 1, 2, 3, 4, 5, 6, 7, or 8 or more modifications, and in certain of these embodiments the linking domain includes 1, 2, 3, or 4 modifications within five nucleotides of its 5' and/or 3' end. In certain embodiments, the linking domain comprises modifications at two or more consecutive nucleotides.

In certain embodiments, modifications to one or more nucleotides in the linking domain are selected to not interfere with targeting efficacy, which can be evaluated by testing a candidate modification in a system as set forth below. gRNAs having a candidate linking domain having a selected length, sequence, degree of complementarity, or degree of modification can be evaluated in a system as set forth below. The candidate linking domain can be placed, either alone or with one or more other candidate changes in a gRNA molecule/Cas9 molecule system known to be functional with a selected target, and evaluated.

In certain embodiments, the linking domain comprises a duplexed region, typically adjacent to or within 1, 2, or 3 nucleotides of the 3' end of the first complementarity domain and/or the 5' end of the second complementarity domain. In certain of these embodiments, the duplexed region of the linking region is 10+/−5, 15+/−5, 20+/−5, 20+/−10, or 30+/−5 bp in length. In certain embodiments, the duplexed region of the linking domain is 1, 2, 3, 4, 5, 6, 7, 8, 9, 10, 11, 12, 13, 14, or 15 bp in length. In certain embodiments, the sequences forming the duplexed region of the linking domain are fully complementarity. In other embodiments, one or both of the sequences forming the duplexed region contain one or more nucleotides (e.g., 1, 2, 3, 4, 5, 6, 7, or 8 nucleotides) that are not complementary with the other duplex sequence.

5' Extension Domain

In certain embodiments, a modular gRNA as disclosed herein comprises a 5' extension domain, i.e., one or more additional nucleotides 5' to the second complementarity domain. In certain embodiments, the 5' extension domain is 2 to 10 or more, 2 to 9, 2 to 8, 2 to 7, 2 to 6, 2 to 5, or 2 to 4 nucleotides in length, and in certain of these embodiments the 5' extension domain is 2, 3, 4, 5, 6, 7, 8, 9, or 10 or more nucleotides in length.

In certain embodiments, the 5' extension domain nucleotides do not comprise modifications, e.g., modifications of the type provided below. However, in certain embodiments, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) as set forth below. In certain embodiments, a nucleotide of the 5' extension domain can comprise a 2' modification (e.g., a modification at the 2' position on ribose), e.g., a 2-acetylation, e.g., a 2' methylation, or other modification(s) as set forth below.

In certain embodiments, the 5' extension domain can comprise as many as 1, 2, 3, 4, 5, 6, 7, or 8 modifications. In certain embodiments, the 5' extension domain comprises as many as 1, 2, 3, or 4 modifications within 5 nucleotides of its 5' end, e.g., in a modular gRNA molecule. In certain embodiments, the 5' extension domain comprises as many as 1, 2, 3, or 4 modifications within 5 nucleotides of its 3' end, e.g., in a modular gRNA molecule.

In certain embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In certain embodiments, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In certain embodiments, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in a system as set forth below. gRNAs having a candidate 5' extension domain having a selected length, sequence, degree of complementarity, or degree of modification, can be evaluated in a system as set forth below. The candidate 5' extension domain can be placed, either alone, or with one or more other candidate changes in a gRNA molecule/Cas9 molecule system known to be functional with a selected target and evaluated.

In certain embodiments, the 5' extension domain has at least 60, 70, 80, 85, 90, or 95% homology with, or differs by no more than 1, 2, 3, 4, 5, or 6 nucleotides from, a reference 5' extension domain, e.g., a naturally occurring, e.g., an *S. pyogenes*, *S. aureus*, or *S. thermophilus*, 5' extension domain, or a 5' extension domain described herein.

Proximal Domain

In certain embodiments, the proximal domain is 5 to 20 or more nucleotides in length, e.g., 5, 6, 7, 8, 9, 10, 11, 12, 13, 14, 15, 16, 17, 18, 19, 20, 21, 22, 23, 24, 25, or 26 nucleotides in length. In certain of these embodiments, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length. In certain embodiments, the proximal domain is 5 to 20, 7, to 18, 9 to 16, or 10 to 14 nucleotides in length.

In certain embodiments, the proximal domain can share homology with or be derived from a naturally occurring proximal domain. In certain of these embodiments, the proximal domain has at least 50%, 60%, 70%, 80%, 85%, 90%, or 95% homology with or differs by no more than 1, 2, 3, 4, 5, or 6 nucleotides from a proximal domain disclosed herein, e.g., an *S. pyogenes, S. aureus*, or *S. thermophilus* proximal domain.

In certain embodiments, the proximal domain does not comprise any modifications. In other embodiments, the proximal domain or one or more nucleotides therein have a modification, including but not limited to the modifications set forth in herein. In certain embodiments, one or more nucleotides of the proximal domain may comprise a 2' modification (e.g., a modification at the 2' position on ribose), e.g., a 2-acetylation, e.g., a 2' methylation. In certain embodiments, the backbone of the proximal domain can be modified with a phosphorothioate. In certain embodiments, modifications to one or more nucleotides of the proximal domain render the proximal domain and/or the gRNA comprising the proximal domain less susceptible to degradation or more bio-compatible, e.g., less immunogenic. In certain embodiments, the proximal domain includes 1, 2, 3, 4, 5, 6, 7, or 8 or more modifications, and in certain of these embodiments the proximal domain includes 1, 2, 3, or 4 modifications within five nucleotides of its 5' and/or 3' end. In certain embodiments, the proximal domain comprises modifications at two or more consecutive nucleotides.

In certain embodiments, modifications to one or more nucleotides in the proximal domain are selected to not interfere with targeting efficacy, which can be evaluated by testing a candidate modification in a system as set forth below. gRNAs having a candidate proximal domain having a selected length, sequence, degree of complementarity, or degree of modification can be evaluated in a system as set forth below. The candidate proximal domain can be placed, either alone or with one or more other candidate changes in a gRNA molecule/Cas9 molecule system known to be functional with a selected target, and evaluated.

Tail Domain

A broad spectrum of tail domains are suitable for use in the gRNA molecules disclosed herein.

In certain embodiments, the tail domain is absent. In other embodiments, the tail domain is 1 to 100 or more nucleotides in length, e.g., 1, 2, 3, 4, 5, 6, 7, 8, 9, 10, 20, 30, 40, 50, 60, 70, 80, 90, or 100 nucleotides in length. In certain embodiments, the tail domain is 1 to 5, 1 to 10, 1 to 15, 1 to 20, 1 to 50, 10 to 100, 20 to 100, 10 to 90, 20 to 90, 10 to 80, 20 to 80, 10 to 70, 20 to 70, 10 to 60, 20 to 60, 10 to 50, 20 to 50, 10 to 40, 20 to 40, 10 to 30, 20 to 30, 20 to 25, 10 to 20, or 10 to 15 nucleotides in length. In certain embodiments, the tail domain is 5+/−5, 10+/−5, 20+/−10, 20+/−5, 25+/−10, 30+/−10, 30+/−5, 40+/−10, 40+/−5, 50+/−10, 50+/−5, 60+/−10, 60+/−5, 70+/−10, 70+/−5, 80+/−10, 80+/−5, 90+/−10, 90+/−5, 100+/−10, or 100+/−5 nucleotides in length, In certain embodiments, the tail domain can share homology with or be derived from a naturally occurring tail domain or the 5' end of a naturally occurring tail domain. In certain of these embodiments, the proximal domain has at least 50%, 60%, 70%, 80%, 85%, 90%, or 95% homology with or differs by no more than 1, 2, 3, 4, 5, or 6 nucleotides from a naturally occurring tail domain disclosed herein, e.g., an *S. pyogenes, S. aureus*, or *S. thermophilus* tail domain.

In certain embodiments, the tail domain includes sequences that are complementary to each other and which, under at least some physiological conditions, form a duplexed region. In certain of these embodiments, the tail domain comprises a tail duplex domain which can form a tail duplexed region. In certain embodiments, the tail duplexed region is 3, 4, 5, 6, 7, 8, 9, 10, 11, or 12 bp in length. In certain embodiments, the tail domain comprises a single stranded domain 3' to the tail duplex domain that does not form a duplex. In certain of these embodiments, the single stranded domain is 3 to 10 nucleotides in length, e.g., 3, 4, 5, 6, 7, 8, 9, 10, or 4 to 6 nucleotides in length.

In certain embodiments, the tail domain does not comprise any modifications. In other embodiments, the tail domain or one or more nucleotides therein have a modification, including but not limited to the modifications set forth herein. In certain embodiments, one or more nucleotides of the tail domain may comprise a 2' modification (e.g., a modification at the 2' position on ribose), e.g., a 2-acetylation, e.g., a 2' methylation. In certain embodiments, the backbone of the tail domain can be modified with a phosphorothioate. In certain embodiments, modifications to one or more nucleotides of the tail domain render the tail domain and/or the gRNA comprising the tail domain less susceptible to degradation or more bio-compatible, e.g., less immunogenic. In certain embodiments, the tail domain includes 1, 2, 3, 4, 5, 6, 7, or 8 or more modifications, and in certain of these embodiments the tail domain includes 1, 2, 3, or 4 modifications within five nucleotides of its 5' and/or 3' end. In certain embodiments, the tail domain comprises modifications at two or more consecutive nucleotides.

In certain embodiments, modifications to one or more nucleotides in the tail domain are selected to not interfere with targeting efficacy, which can be evaluated by testing a candidate modification as set forth below. gRNAs having a candidate tail domain having a selected length, sequence, degree of complementarity, or degree of modification can be evaluated using a system as set forth below. The candidate tail domain can be placed, either alone or with one or more other candidate changes in a gRNA molecule/Cas9 molecule system known to be functional with a selected target, and evaluated.

In Vivo and In Vitro Transcription of gRNAs

In certain embodiments, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When an H1 promoter is used for transcription, these nucleotides may be the sequence UUUU. When alternate pol-III promoters are used, these nucleotides may be various numbers of uracil bases depending on, e.g., the termination signal of the pol-III promoter, or they may include alternate bases. In certain embodiments, the proximal and tail domain taken together comprise, consist of, or consist essentially of the sequence set forth in SEQ ID NOs: 33, 34, 35, 36, or 38.

Given that the T7 RNA polymerase requires a G to initiate transcription, the T7 promoter typically has two Gs at its 3' end to ensure transcription of the entire RNA sequence downstream of the promoter. The consequence, however, is that the transcript that is produced may contain at least one if not both of the Gs from the promoter sequence, which may alter the gRNA specificity or the interaction between the gRNA and the Cas9 protein. To address this concern in cases where the gRNA target sequence starts with a G (e.g., HBB_8 gRNA target region DNA template:

GTAACGGCAGACTTCTCCTC, (SEQ ID NO: 486)

the two GGs can be removed from the T7 promoter sequence in the gRNA PCR template by designing a new 5' sense primer (CACCGCTAGCTAATACGACTCACTATAGTAACGGCAGACTTCTCCTCGT TTTAGAGCTAGAAATA (SEQ ID NO: 487 where the modified T7 promoter sequence is underlined).

For gRNA target sequences that don't start with a G (e.g., HBB_15 gRNA target region DNA template:

AAGGTGAACGTGGATGAAGT, (SEQ ID NO: 488)

the T7 promoter sequence encoded in the gRNA PCR template can be modified such that only one of the Gs at the 3' end of the T7 promoter was removed: (modified T7 promoter sequence: TAATACGACTCACTATAG (SEQ ID NO:489).

A T7 promoter sequence and modified T7 promoter sequence is not limited to the sequences described herein. For example, T7 promoter sequences (and modifications thereof) can be at least any of the sequences referred to in "Promoters/Catalog/T7" of the Registry of Standard Biological Parts (located at the following http://address:parts.igem.org/Promoters/Catalog/T7). It is to be understood that the present disclosure encompasses methods where a gRNA disclosed herein is prepared by in vitro transcription from a DNA template that includes a modified T7 promoter as described herein where one or more of the 3' terminal Gs have been removed (e.g., where the sequence TAATACGACTCACTATAG (SEQ ID NO:489) is located immediately upstream of a targeting domain that lacks a G at it's 5' end or the sequence TAATACGACTCACTATA (SEQ ID NO:490) is located immediately upstream of a targeting domain that has a G at it's 5' end). Other variations on these modified T7 promoters will be recognized by those skilled in the art based on other T7 promoter sequences including at least any of the sequences referred to in "Promoters/Catalog/T7" of the Registry of Standard Biological Parts (located at the following http://address:parts.igem.org/Promoters/Catalog/T7 and incorporated herein by reference in its entirety).

Exemplary Unimolecular/Chimeric gRNAs

In certain embodiments, a gRNA as disclosed herein has the structure: 5' [targeting domain]-[first complementarity domain]-[linking domain]-[second complementarity domain]-[proximal domain]-[tail domain]-3', wherein:

the targeting domain comprises a core domain and optionally a secondary domain, and is 10 to 50 nucleotides in length;

the first complementarity domain is 5 to 25 nucleotides in length and, in certain embodiments has at least 50, 60, 70, 80, 85, 90, or 95% homology with a reference first complementarity domain disclosed herein;

the linking domain is 1 to 5 nucleotides in length;

the second complementarity domain is 5 to 27 nucleotides in length and, in certain embodiments has at least 50, 60, 70, 80, 85, 90, or 95% homology with a reference second complementarity domain disclosed herein;

the proximal domain is 5 to 20 nucleotides in length and, in certain embodiments has at least 50, 60, 70, 80, 85, 90, or 95% homology with a reference proximal domain disclosed herein; and the tail domain is absent or a nucleotide sequence is 1 to 50 nucleotides in length and, in certain embodiments has at least 50, 60, 70, 80, 85, 90, or 95% homology with a reference tail domain disclosed herein.

In certain embodiments, a unimolecular gRNA as disclosed herein comprises, preferably from 5' to 3': a targeting domain, e.g., comprising 10-50 nucleotides; a first complementarity domain, e.g., comprising 15, 16, 17, 18, 19, 20, 21, 22, 23, 24, 25, or 26 nucleotides; a linking domain; a second complementarity domain; a proximal domain; and a tail domain, wherein, (a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), and/or (c) has at least 50%, 60%, 70%, 75%, 80%, 85%, 90%, 95%, or 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that are complementary to the corresponding nucleotides of the first complementarity domain.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary or partially complementary to the target domain or a portion thereof, e.g., the targeting domain is 16, 17, 18, 19, 20, 21, 22, 23, 24, 25, or 26 nucleotides in length. In certain of these embodiments, the targeting domain is complementary to the target domain over the entire length of the targeting domain, the entire length of the target domain, or both.

In certain embodiments, a unimolecular or chimeric gRNA molecule disclosed herein (comprising a targeting domain, a first complementary domain, a linking domain, a second complementary domain, a proximal domain and, optionally, a tail domain) comprises the amino acid sequence set forth in SEQ ID NO:45, wherein the targeting domain is listed as 20 N's (residues 1-20) but may range in length from 16 to 26 nucleotides, and wherein the final six residues (residues 97-102) represent a termination signal for the U6 promoter buy may be absent or fewer in number. In certain embodiments, the unimolecular, or chimeric, gRNA molecule is a *S. pyogenes* gRNA molecule.

In certain embodiments, a unimolecular or chimeric gRNA molecule disclosed herein (comprising a targeting domain, a first complementary domain, a linking domain, a second complementary domain, a proximal domain and, optionally, a tail domain) comprises the amino acid sequence set forth in SEQ ID NO:40, wherein the targeting domain is listed as 20 Ns (residues 1-20) but may range in length from 16 to 26 nucleotides, and wherein the final six residues (residues 97-102) represent a termination signal for the U6 promoter but may be absent or fewer in number. In certain embodiments, the unimolecular or chimeric gRNA molecule is an *S. aureus* gRNA molecule.

Exemplary Modular gRNAs

In certain embodiments, a modular gRNA disclosed herein comprises: a first strand comprising, preferably from 5' to 3'; a targeting domain, e.g., comprising 15, 16, 17, 18, 19, 20, 21, 22, 23, 24, 25, or 26 nucleotides; a first complementarity domain; and a second strand, comprising, preferably from 5' to 3': optionally a 5' extension domain; a second complementarity domain; a proximal domain; and a tail domain, wherein:

(a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), or (c), has at least 60, 75, 80, 85, 90, 95, or 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 16, 17, 18, 19, 20, 21, 22, 23, 24, 25, or 26 nucleotides (e.g., 16, 17, 18, 19, 20, 21, 22, 23, 24, 25, or 26 consecutive nucleotides) having complementarity with the target domain, e.g., the targeting domain is 16, 17, 18, 19, 20, 21, 22, 23, 24, 25, or 26 nucleotides in length.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary to the target domain or a portion thereof. In certain of these embodiments, the targeting domain is complementary to the target domain over the entire length of the targeting domain, the entire length of the target domain, or both.

In certain embodiments, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In certain embodiments, the targeting domain has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In certain embodiments, the targeting domain has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

III. Methods for Designing gRNA Molecules

Methods for selecting, designing, and validating targeting domains for use in the gRNAs described herein are provided. Exemplary targeting domains for incorporation into gRNAs are also provided herein.

Methods for selection and validation of target sequences as well as off-target analyses have been described (see, e.g., Mali 2013; Hsu 2013; Fu 2014; Heigwer 2014; Bae 2014; and Xiao 2014). For example, a software tool can be used to optimize the choice of potential targeting domains corresponding to a user's target sequence, e.g., to minimize total off-target activity across the genome. Off-target activity may be other than cleavage. For each possible targeting domain choice using *S. pyogenes* Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible targeting domain is then ranked according to its total predicted off-target cleavage; the top-ranked targeting domains represent those that are likely to have the greatest on-target cleavage and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate targeting domains and gRNAs comprising those targeting domains can be functionally evaluated by using methods known in the art and/or as set forth herein.

As a non-limiting example, targeting domains for use in gRNAs for use with *S. pyogenes, N. meningiitidis* and *S. aureus* Cas9s are identified using a DNA sequence searching algorithm. 17-mer and 20-mer targeting domains are designed for *S. pyogenes* targets, while 18-mer, 19-mer, 20-mer, 21-mer, 22-mer, 23-mer, and 24-mer targeting domains are designed for *S. aureus* targets. gRNA design is carried out using a custom gRNA design software based on the public tool cas-offinder (Bae 2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a HBB gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, targeting domains are ranked into tiers based on their distance to the target site, their orthogonality and presence of a 5' G (based on identification of close matches in the human genome containing a relevant PAM e.g., NGG PAM for *S. pyogenes*, NNNNGATT or NNNNGCTT PAM for *N. meningitides*, and NNGRRT or NNGRRV PAM for *S. aureus*. Orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality are selected to minimize off-target DNA cleavage.

Targeting domains are identified for both single-gRNA nuclease cleavage and for a dual-gRNA paired "nickase" strategy. Criteria for selecting targeting domains and the determination of which targeting domains can be incorporated into a gRNA and used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNA molecules. Candidate pair members can be tested for how efficiently they remove the entire sequence versus causing indel mutations at the target site of one gRNA molecule.

In certain embodiments, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

In certain embodiments, dual targeting is used to create two nicks on opposite DNA strands by using Cas9 nickases (e.g., a *S. pyogenes* Cas9 nickase) with two targeting domains that are complementary to opposite DNA strands, e.g., a gRNA molecule comprising any minus strand targeting domain may be paired any gRNA molecule comprising a plus strand targeting domain provided that the two gRNAs are oriented on the DNA such that PAMs face outward and the distance between the 5' ends of the gRNAs is 0-50 bp. When selecting gRNA molecules for use in a nickase pair, one gRNA molecule targets a domain in the complementary strand and the second gRNA molecule targets a domain in the non-complementary strand, e.g., a gRNA comprising any minus strand targeting domain may be paired any gRNA molecule comprising a plus strand targeting domain targeting the same target position. In certain embodiments, two 20-mer gRNAs are used to target two Cas9 nucleases (e.g., two *S. pyogenes* Cas9 nucleases) or two Cas9 nickases (e.g., two *S. pyogenes* Cas9 nickases), e.g., two gRNAs comprising the targeting domains of HBB-8 (SEQ ID NO: 388) and HBB-15 (SEQ ID NO: 387) are used. In certain embodiments, two 17-mer gRNAs are used to target two Cas9 nucleases or two Cas9 nickases, are used. Any of the targeting domains in the tables described herein can be used with a Cas9 molecule that generates a single-strand break (i.e., *S. pyogenes*, *N. meningitidis* or *S. aureus* Cas9 nickase) or with a Cas9 molecule that generates a double-strand break (i.e., *S. pyogenes*, *N. meningitidis*, or *S. aureus* Cas9 nuclease).

In certain embodiments, the targeting domain comprises a sequence that is the same as, or differs by no more than 1, 2, 3, 4, or 5 nucleotides from, a targeting domain sequence described herein. In certain embodiments, the targeting domain is a targeting domain sequence described herein gRNA molecules, as described herein, may comprise from 5' to 3': a targeting domain (comprising a "core domain", and optionally a "secondary domain"); a first complementarity domain; a linking domain; a second complementarity domain; a proximal domain; and a tail domain. In one embodiment, the proximal domain and tail domain are taken together as a single domain.

In one embodiment, a gRNA molecule comprises a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In another embodiment, a gRNA molecule comprises a linking domain of no more than 25 nucleotides in length; a proximal and tail domain, that taken together, are at least 25 nucleotides in length; and a targeting domain equal to or greater than 16, 17, 18, 19, 20, 21, 22, 23, 24, 25 or 26 nucleotides in length.

In another embodiment, a gRNA molecule comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA molecule comprises a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

When two gRNAs are designed for use with two Cas9 molecules, the two Cas9 molecules may be from different species. Both Cas9 species may be used to generate a single or double strand break, as desired.

It is contemplated herein that any upstream gRNA described herein may be paired with any downstream gRNA described herein. When an upstream gRNA designed for use with one species of Cas9 molecule is paired with a downstream gRNA designed for use from a different species of Cas9 molecule, both Cas9 species are used to generate a single or double-strand break, as desired.

IV. Cas9 Molecules

Cas9 molecules of a variety of species can be used in the methods and compositions described herein. While *Streptococcus pyogenes S. thermophilus*, and *Staphylococcus aureus* Cas9 molecules are the subject of much of the disclosure herein, Cas9 molecules of, derived from, or based on the Cas9 proteins of other species listed herein can be used as well. These include, for example, Cas9 molecules from *Acidovorax avenae, Actinobacillus pleuropneumoniae, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus Puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria meningitidis, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae*. The amino acid sequences of exemplary Cas9 orthologs are set forth in SEQ ID NOs: 304-386.

Cas9 Domains

Crystal structures have been determined for two different naturally occurring bacterial Cas9 molecules (Jinek et al. 2014) and for *S. pyogenes* Cas9 with a guide RNA (e.g., a synthetic fusion of crRNA and tracrRNA) (Nishimasu et al. 2014; and Anders 2014).

A naturally-occurring Cas9 molecule comprises two lobes: a recognition (REC) lobe and a nuclease (NUC) lobe; each of which further comprise domains described herein. The domain nomenclature and the numbering of the amino acid residues encompassed by each domain used throughout this disclosure is as described previously in (Nishimasu 2014). The numbering of the amino acid residues is with reference to Cas9 from *S. pyogenes*.

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat: anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat: anti-repeat duplex. The REC2 domain comprises amino acids 180-307 of the sequence of *S. pyogenes* Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

RuvC-Like Domain and an HNH-Like Domain

In certain embodiments, a Cas9 molecule or Cas9 polypeptide comprises an HNH-like domain and a RuvC-like domain and in certain of these embodiments cleavage activity is dependent on the RuvC-like domain and the HNH-like domain. A Cas9 molecule or Cas9 polypeptide can comprise one or more of a RuvC-like domain and an HNH-like domain. In certain embodiments, a Cas9 molecule or Cas9 polypeptide comprises a RuvC-like domain, e.g., a RuvC-like domain described below, and/or an HNH-like domain, e.g., an HNH-like domain described below.

RuvC-Like Domains

In certain embodiments, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In certain embodiments, a RuvC-like domain is at least 5, 6, 7, 8 amino acids in length but not more than 20, 19, 18, 17, 16 or 15 amino acids in length. In certain embodiments, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, a Cas9 molecule or Cas9 polypeptide can comprise an N-terminal RuvC-like domain. Exemplary N-terminal RuvC-like domains are described below.

In certain embodiments, a Cas9 molecule or Cas9 polypeptide comprises an N-terminal RuvC-like domain comprising an amino acid sequence of Formula I:

$$D-X_1-G-X_2-X_3-X_4-X_5-G-X_6-X_7-X_8-X_9, \quad \text{(SEQ ID NO: 8)}$$

wherein, $X_1$ is selected from I, V, M, L and T (e.g., selected from I, V, and L);

$X_2$ is selected from T, I, V, S, N, Y, E and L (e.g., selected from T, V, and I);

$X_3$ is selected from N, S, G, A, D, T, R, M and F (e.g., A or N);

$X_4$ is selected from S, Y, N and F (e.g., S);

$X_5$ is selected from V, I, L, C, T and F (e.g., selected from V, I and L);

$X_6$ is selected from W, F, V, Y, S and L (e.g., W);

$X_7$ is selected from A, S, C, V and G (e.g., selected from A and S);

$X_8$ is selected from V, I, L, A, M and H (e.g., selected from V, I, M and L); and $X_9$ is selected from any amino acid or is absent (e.g., selected from T, V, I, L, A, F, S, A, Y, M and R, or, e.g., selected from T, V, I, L and A).

In certain embodiments, the N-terminal RuvC-like domain differs from a sequence of SEQ ID NO:8, by as many as 1 but no more than 2, 3, 4, or 5 residues.

In certain embodiments, the N-terminal RuvC-like domain is cleavage competent.

In other embodiments, the N-terminal RuvC-like domain is cleavage incompetent.

In certain embodiments, a Cas9 molecule or Cas9 polypeptide comprises an N-terminal RuvC-like domain comprising an amino acid sequence of Formula II:

$$D-X_1-G-X_2-X_3-S-X_5-G-X_6-X_7-X_8-X_9,, \quad \text{(SEQ ID NO: 9)}$$

wherein $X_1$ is selected from I, V, M, L and T (e.g., selected from I, V, and L);

$X_2$ is selected from T, I, V, S, N, Y, E and L (e.g., selected from T, V, and I);

$X_3$ is selected from N, S, G, A, D, T, R, M and F (e.g., A or N);

$X_5$ is selected from V, I, L, C, T and F (e.g., selected from V, I and L);

$X_6$ is selected from W, F, V, Y, S and L (e.g., W);

$X_7$ is selected from A, S, C, V and G (e.g., selected from A and S);

$X_8$ is selected from V, I, L, A, M and H (e.g., selected from V, I, M and L); and $X_9$ is selected from any amino acid or is absent (e.g., selected from T, V, I, L, A, F, S, A, Y, M and R or selected from e.g., T, V, I, L and A).

In certain embodiments, the N-terminal RuvC-like domain differs from a sequence of SEQ ID NO:9 by as many as 1 but not more than 2, 3, 4, or 5 residues.

In certain embodiments, the N-terminal RuvC-like domain comprises an amino acid sequence of Formula III:

D-I-G-$X_2$-$X_3$-S-V-G-W-A-$X_8$-$X_9$, (SEQ ID NO: 10)

wherein $X_2$ is selected from T, I, V, S, N, Y, E and L (e.g., selected from T, V, and I);

$X_3$ is selected from N, S, G, A, D, T, R, M and F (e.g., A or N);

$X_8$ is selected from V, I, L, A, M and H (e.g., selected from V, I, M and L); and $X_9$ is selected from any amino acid or is absent (e.g., selected from T, V, I, L, A, F, S, A, Y, M and R or selected from e.g., T, V, I, L and A).

In certain embodiments, the N-terminal RuvC-like domain differs from a sequence of SEQ ID NO:10 by as many as 1 but not more than, 2, 3, 4, or 5 residues.

In certain embodiments, the N-terminal RuvC-like domain comprises an amino acid sequence of Formula IV:

D-I-G-T-N-S-V-G-W-A-V-X, (SEQ ID NO: 11)

wherein

X is a non-polar alkyl amino acid or a hydroxyl amino acid, e.g., X is selected from V, I, L and T.

In certain embodiments, the N-terminal RuvC-like domain differs from a sequence of SEQ ID NO:11 by as many as 1 but not more than, 2, 3, 4, or 5 residues.

In certain embodiments, the N-terminal RuvC-like domain differs from a sequence of an N-terminal RuvC like domain disclosed herein, e.g., in any one of SEQ ID Nos: 54-103, as many as 1 but no more than 2, 3, 4, or 5 residues. In certain embodiments, 1, 2, 3 or all of the highly conserved residues of SEQ ID Nos: 54-103 are present.

In certain embodiment, the N-terminal RuvC-like domain differs from a sequence of an N-terminal RuvC-like domain disclosed herein, e.g., in any one of SEQ ID Nos: 104-177, as many as 1 but no more than 2, 3, 4, or 5 residues. In certain embodiments, 1, 2, or all of the highly conserved residues identified of SEQ ID Nos: 104-177 are present.

Additional RuvC-Like Domains

In addition to the N-terminal RuvC-like domain, the Cas9 molecule or Cas9 polypeptide can comprise one or more additional RuvC-like domains. In certain embodiments, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence of Formula V:

I-$X_1$-$X_2$-E-$X_3$-A-R-E (SEQ ID NO:12), wherein $X_1$ is V or H;

$X_2$ is I, L or V (e.g., I or V); and $X_3$ is M or T.

In certain embodiments, the additional RuvC-like domain comprises an amino acid sequence of Formula VI:

I-V-$X_2$-E-M-A-R-E (SEQ ID NO:13), wherein $X_2$ is I, L or V (e.g., I or V).

An additional RuvC-like domain can comprise an amino acid sequence of Formula VII:

H-H-A-$X_1$-D-A-$X_2$-$X_3$ (SEQ ID NO: 14), wherein $X_1$ is H or L;

$X_2$ is R or V; and $X_3$ is E or V.

In certain embodiments, the additional RuvC-like domain comprises the amino acid sequence: H-H-A-H-D-A-Y-L (SEQ ID NO:15).

In certain embodiments, the additional RuvC-like domain differs from a sequence of SEQ ID NOs: 12-15 by as many as 1 but not more than 2, 3, 4, or 5 residues.

In certain embodiment, the sequence flanking the N-terminal RuvC-like domain has the amino acid sequence of Formula VIII:

K-$X_1'$-Y-$X_2'$-$X_3'$-$X_4'$-Z-T-D-$X_9'$-Y, . (SEQ ID NO: 16)

wherein $X_1'$ is selected from K and P;

$X_2'$ is selected from V, L, I, and F (e.g., V, I and L);

$X_3'$ is selected from G, A and S (e.g., G);

$X_4'$ is selected from L, I, V and F (e.g., L);

$X_9'$ is selected from D, E, N and Q; and

Z is an N-terminal RuvC-like domain, e.g., as described above, e.g., having 5 to 20 amino acids.

HNH-Like Domains

In certain embodiments, an HNH-like domain cleaves a single stranded complementary domain, e.g., a complementary strand of a double stranded nucleic acid molecule. In certain embodiments, an HNH-like domain is at least 15, 20, or 25 amino acids in length but not more than 40, 35, or 30 amino acids in length, e.g., 20 to 35 amino acids in length, e.g., 25 to 30 amino acids in length. Exemplary HNH-like domains are described below.

In certain embodiments, a Cas9 molecule or Cas9 polypeptide comprises an HNH-like domain having an amino acid sequence of Formula IX:

$X_1$-$X_2$-$X_3$-H-$X_4$-$X_5$-P-$X_6$-$X_7$-$X_8$-$X_9$-$X_{10}$-$X_{11}$-$X_{12}$-$X_{13}$-$X_{14}$-$X_{15}$-N-$X_{16}$-$X_{17}$-$X_{18}$-$X_{19}$-$X_{20}$-$X_{21}$-$X_{22}$-$X_{23}$-N (SEQ ID NO: 17), wherein $X_1$ is selected from D, E, Q and N (e.g., D and E);

$X_2$ is selected from L, I, R, Q, V, M and K;

$X_3$ is selected from D and E;

$X_4$ is selected from I, V, T, A and L (e.g., A, I and V);

$X_5$ is selected from V, Y, I, L, F and W (e.g., V, I and L);

$X_6$ is selected from Q, H, R, K, Y, I, L, F and W;

$X_7$ is selected from S, A, D, T and K (e.g., S and A);

$X_8$ is selected from F, L, V, K, Y, M, I, R, A, E, D and Q (e.g., F);

$X_9$ is selected from L, R, T, I, V, S, C, Y, K, F and G;

$X_{10}$ is selected from K, Q, Y, T, F, L, W, M, A, E, G, and S;

$X_{11}$ is selected from D, S, N, R, L and T (e.g., D);

$X_{12}$ is selected from D, N and S;

$X_{13}$ is selected from S, A, T, G and R (e.g., S);

$X_{14}$ is selected from I, L, F, S, R, Y, Q, W, D, K and H (e.g., I, L and F);

$X_{15}$ is selected from D, S, I, N, E, A, H, F, L, Q, M, G, Y and V;

$X_{16}$ is selected from K, L, R, M, T and F (e.g., L, R and K);

$X_{17}$ is selected from V, L, I, A and T;

$X_{18}$ is selected from L, I, V and A (e.g., L and I);

$X_{19}$ is selected from T, V, C, E, S and A (e.g., T and V);
$X_{20}$ is selected from R, F, T, W, E, L, N, C, K, V, S, Q, I, Y, H and A;
$X_{21}$ is selected from S, P, R, K, N, A, H, Q, G and L;
$X_{22}$ is selected from D, G, T, N, S, K, A, I, E, L, Q, R and Y; and
$X_{23}$ is selected from K, V, A, E, Y, I, C, L, S, T, G, K, M, D and F.

In certain embodiments, a HNH-like domain differs from a sequence of SEQ ID NO: 17 by at least one but not more than, 2, 3, 4, or 5 residues.

In certain embodiments, the HNH-like domain is cleavage competent.

In other embodiments, the HNH-like domain is cleavage incompetent.

In certain embodiments, a Cas9 molecule or Cas9 polypeptide comprises an HNH-like domain comprising an amino acid sequence of Formula X:

(SEQ ID NO: 18)
$X_1$-$X_2$-$X_3$-H-$X_4$-$X_5$-P-$X_6$-S-$X_8$-$X_9$-$X_{10}$-D-D-S-$X_{14}$-$X_{15}$-N-K-V-L-$X_{19}$-$X_{20}$-$X_{21}$-$X_{22}$-$X_{23}$-N, wherein
$X_1$ is selected from D and E;
$X_2$ is selected from L, I, R, Q, V, M and K;
$X_3$ is selected from D and E;
$X_4$ is selected from I, V, T, A and L (e.g., A, I and V);
$X_5$ is selected from V, Y, I, L, F and W (e.g., V, I and L);
$X_6$ is selected from Q, H, R, K, Y, I, L, F and W;
$X_8$ is selected from F, L, V, K, Y, M, I, R, A, E, D and Q (e.g., F);
$X_9$ is selected from L, R, T, I, V, S, C, Y, K, F and G;
$X_{10}$ is selected from K, Q, Y, T, F, L, W, M, A, E, G, and S;
$X_{14}$ is selected from I, L, F, S, R, Y, Q, W, D, K and H (e.g., I, L and F);
$X_{15}$ is selected from D, S, I, N, E, A, H, F, L, Q, M, G, Y and V;
$X_{19}$ is selected from T, V, C, E, S and A (e.g., T and V);
$X_{20}$ is selected from R, F, T, W, E, L, N, C, K, V, S, Q, I, Y, H and A;
$X_{21}$ is selected from S, P, R, K, N, A, H, Q, G and L;
$X_{22}$ is selected from D, G, T, N, S, K, A, I, E, L, Q, R and Y; and
$X_{23}$ is selected from K, V, A, E, Y, I, C, L, S, T, G, K, M, D and F.

In certain embodiments, the HNH-like domain differs from a sequence of SEQ ID NO: 18 by 1, 2, 3, 4, or 5 residues.

In certain embodiments, a Cas9 molecule or Cas9 polypeptide comprises an HNH-like domain comprising an amino acid sequence of Formula XI:

(SEQ ID NO: 19)
$X_1$-V-$X_3$-H-I-V-P-$X_6$-S-$X_8$-$X_9$-$X_{10}$-D-D-S-$X_{14}$-$X_{15}$-N-K-V-L-T-$X_{20}$-$X_{21}$-$X_{22}$-$X_{23}$-N, wherein
$X_1$ is selected from D and E;
$X_3$ is selected from D and E;
$X_6$ is selected from Q, H, R, K, Y, I, L and W;
$X_8$ is selected from F, L, V, K, Y, M, I, R, A, E, D and Q (e.g., F);
$X_9$ is selected from L, R, T, I, V, S, C, Y, K, F and G;

$X_{10}$ is selected from K, Q, Y, T, F, L, W, M, A, E, G, and S;
$X_{14}$ is selected from I, L, F, S, R, Y, Q, W, D, K and H (e.g., I, L and F);
$X_{15}$ is selected from D, S, I, N, E, A, H, F, L, Q, M, G, Y and V;
$X_{20}$ is selected from R, F, T, W, E, L, N, C, K, V, S, Q, I, Y, H and A;
$X_{21}$ is selected from S, P, R, K, N, A, H, Q, G and L;
$X_{22}$ is selected from D, G, T, N, S, K, A, I, E, L, Q, R and Y; and
$X_{23}$ is selected from K, V, A, E, Y, I, C, L, S, T, G, K, M, D and F.

In certain embodiments, the HNH-like domain differs from a sequence of SEQ ID NO: 19 by 1, 2, 3, 4, or 5 residues.

In certain embodiments, a Cas9 molecule or Cas9 polypeptide comprises an HNH-like domain having an amino acid sequence of Formula XII:

(SEQ ID NO: 20)
D-$X_2$-D-H-I-$X_5$-P-Q-$X_7$-F-$X_9$-$X_{10}$-D-$X_{12}$-S-I-D-N-$X_{16}$-V-L-$X_{19}$-$X_{20}$-S-$X_{22}$-$X_{23}$-N, wherein
$X_2$ is selected from I and V;
$X_5$ is selected from I and V;
$X_7$ is selected from A and S;
$X_9$ is selected from I and L;
$X_{10}$ is selected from K and T;
$X_{12}$ is selected from D and N;
$X_{16}$ is selected from R, K and L;
$X_{19}$ is selected from T and V;
$X_{20}$ is selected from S and R;
$X_{22}$ is selected from K, D and A; and
$X_{23}$ is selected from E, K, G and N (e.g., the Cas9 molecule or Cas9 polypeptide can comprise an HNH-like domain as described herein).

In certain embodiments, the HNH-like domain differs from a sequence of SEQ ID NO: 20 by as many as 1 but not more than 2, 3, 4, or 5 residues.

In certain embodiments, a Cas9 molecule or Cas9 polypeptide comprises the amino acid sequence of formula XIII:

(SEQ ID NO: 21)
L-Y-Y-L-Q-N-G-$X_1$'-D-M-Y-$X_2$'-$X_3$'-$X_4$'-$X_5$'-L-D-I-$X_6$'-$X_7$'-L-S-$X_8$'-Y-Z-N-R-$X_9$'-K-$X_{10}$'-D-$X_{11}$'-V-P, wherein
$X_1$' is selected from K and R;
$X_2$' is selected from V and T;
$X_3$' is selected from G and D;
$X_4$' is selected from E, Q and D;
$X_5$' is selected from E and D;
$X_6$' is selected from D, N and H;
$X_7$' is selected from Y, R and N;
$X_8$' is selected from Q, D and N;
$X_9$' is selected from G and E;
$X_{10}$' is selected from S and G;
$X_{11}$' is selected from D and N; and
Z is an HNH-like domain, e.g., as described above.

In certain embodiment, a Cas9 molecule or Cas9 polypeptide comprises an amino acid sequence that differs from a sequence of SEQ ID NO:21 by as many as 1 but not more than 2, 3, 4, or 5 residues.

In certain embodiments, the HNH-like domain differs from a sequence of an HNH-like domain disclosed herein, e.g., in SEQ ID Nos: 178-252, as many as 1 but not more than 2, 3, 4, or 5 residues. In certain embodiments, 1 or both of the highly conserved residues of SEQ ID Nos: 178-252 are present.

In certain embodiments, the HNH-like domain differs from a sequence of an HNH-like domain disclosed herein, e.g., in SEQ ID Nos: 253-302, as many as 1 but not more than 2, 3, 4, or 5 residues. In certain embodiments, 1, 2, all 3 of the highly conserved residues of SEQ ID Nos: 253-302 are present.

Cas9 Activities

In certain embodiments, the Cas9 molecule or Cas9 polypeptide is capable of cleaving a target nucleic acid molecule. Typically wild-type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In certain embodiments, an eaCas9 molecule or eaCas9 polypeptide comprises one or more of the following enzymatic activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which In one embodiment is the presence of two nickase activities;

an endonuclease activity;

an exonuclease activity; and a helicase activity, i.e., the ability to unwind the helical structure of a double stranded nucleic acid.

In certain embodiments, an enzymatically active Cas9 or eaCas9 molecule or eaCas9 polypeptide cleaves both DNA strands and results in a double stranded break. In certain embodiments, an eaCas9 molecule or eaCas9 polypeptide cleaves only one strand, e.g., the strand to which the gRNA hybridizes to, or the strand complementary to the strand the gRNA hybridizes with. In one embodiment, an eaCas9 molecule or eaCas9 polypeptide comprises cleavage activity associated with an HNH domain. In one embodiment, an eaCas9 molecule or eaCas9 polypeptide comprises cleavage activity associated with a RuvC domain. In one embodiment, an eaCas9 molecule or eaCas9 polypeptide comprises cleavage activity associated with an HNH domain and cleavage activity associated with a RuvC domain. In one embodiment, an eaCas9 molecule or eaCas9 polypeptide comprises an active, or cleavage competent, HNH domain and an inactive, or cleavage incompetent, RuvC domain. In one embodiment, an eaCas9 molecule or eaCas9 polypeptide comprises an inactive, or cleavage incompetent, HNH domain and an active, or cleavage competent, RuvC domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide that can interact with a gRNA molecule and, in concert with the gRNA molecule, localizes to a site which comprises a target domain, and in certain embodiments, a PAM sequence.

In certain embodiments, the ability of an eaCas9 molecule or eaCas9 polypeptide to interact with and cleave a target nucleic acid is PAM sequence dependent. A PAM sequence is a sequence in the target nucleic acid. In one embodiment, cleavage of the target nucleic acid occurs upstream from the PAM sequence. eaCas9 molecules from different bacterial species can recognize different sequence motifs (e.g., PAM sequences). In one embodiment, an eaCas9 molecule of S. pyogenes recognizes the sequence motif NGG and directs cleavage of a target nucleic acid sequence 1 to 10, e.g., 3 to 5, bp upstream from that sequence (see, e.g., Mali 2013). In one embodiment, an eaCas9 molecule of S. thermophilus recognizes the sequence motif NGGNG (SEQ ID NO: 506) and/or NNAGAAW (W=A or T; SEQ ID NO: 507) and directs cleavage of a target nucleic acid sequence 1 to 10, e.g., 3 to 5, bp upstream from these sequences (see, e.g., Horvath 2010; Deveau 2008). In one embodiment, an eaCas9 molecule of S. mutans recognizes the sequence motif NGG and/or NAAR (R=A or G; SEQ ID NO: 508) and directs cleavage of a target nucleic acid sequence 1 to 10, e.g., 3 to 5, bp upstream from this sequence (see, e.g., Deveau 2008). In one embodiment, an eaCas9 molecule of S. aureus recognizes the sequence motif NNGRR (R=A or G; SEQ ID NO: 509) and directs cleavage of a target nucleic acid sequence 1 to 10, e.g., 3 to 5, bp upstream from that sequence. In one embodiment, an eaCas9 molecule of S. aureus recognizes the sequence motif NNGRRN (R=A or G; SEQ ID NO: 510) and directs cleavage of a target nucleic acid sequence 1 to 10, e.g., 3 to 5, bp upstream from that sequence. In one embodiment, an eaCas9 molecule of S. aureus recognizes the sequence motif NNGRRT (R=A or G; SEQ ID NO: 511) and directs cleavage of a target nucleic acid sequence 1 to 10, e.g., 3 to 5, base pairs upstream from that sequence. In one embodiment, an eaCas9 molecule of S. aureus recognizes the sequence motif NNGRRV (R=A or G; SEQ ID NO: 512) and directs cleavage of a target nucleic acid sequence 1 to 10, e.g., 3 to 5, bp upstream from that sequence. The ability of a Cas9 molecule to recognize a PAM sequence can be determined, e.g., using a transformation assay as described in Jinek 2012. In the aforementioned embodiments, N can be any nucleotide residue, e.g., any of A, G, C, or T.

As is discussed herein, Cas9 molecules can be engineered to alter the PAM specificity of the Cas9 molecule.

Exemplary naturally occurring Cas9 molecules have been described previously (see, e.g., Chylinski 2013). Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. aureus, S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408).

In certain embodiments, a Cas9 molecule or Cas9 polypeptide comprises an amino acid sequence: having 60%, 65%, 70%, 75%, 80%, 85%, 90%, 95%, 96%, 97%, 98% or 99% homology with; differs at no more than, 2, 5, 10, 15, 20, 30, or 40% of the amino acid residues when compared with; differs by at least 1, 2, 5, 10 or 20 amino acids, but by no more than 100, 80, 70, 60, 50, 40 or 30 amino acids from; or is identical to any Cas9 molecule sequence described herein, or to a naturally occurring Cas9 molecule sequence, e.g., a Cas9 molecule from a species listed herein (e.g., SEQ ID NO: 1-4 or described in Chylinski 2013 or Hou 2013). In one embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

A comparison of the sequence of a number of Cas9 molecules indicate that certain regions are conserved. These are identified below as:

region 1 (residues 1 to 180, or in the case of region 1, residues 120 to 180)
region 2 (residues 360 to 480);
region 3 (residues 660 to 720);
region 4 (residues 817 to 900); and
region 5 (residues 900 to 960).

In one embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In one embodiment, each of regions 1-5, independently, have 50%, 60%, 70%, 80%, 85%, 90%, 95%, 96%, 97%, 98% or 99% homology with the corresponding residues of a Cas9 molecule or Cas9 polypeptide described herein, e.g., a sequence from SEQ ID Nos: 1-4.

In one embodiment, a Cas9 molecule or Cas9 polypeptide comprises an amino acid sequence referred to as region 1:
having 50%, 60%, 70%, 80%, 85%, 90%, 95%, 96%, 97%, 98% or 99% homology with amino acids 1-180 of the amino acid sequence of Cas9 of *S. pyogenes;*
differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans,* or *Listeria innocua;* or
is identical to amino acids 1-180 of the amino acid sequence of Cas9 of *S. pyogenes, S. thermophilus, S. mutans,* or *L. innocua.*

In one embodiment, a Cas9 molecule or Cas9 polypeptide comprises an amino acid sequence referred to as region 1':
having 55%, 60%, 65%, 70%, 75%, 80%, 85%, 90%, 95%, 96%, 97%, 98% or 99% homology with amino acids 120-180 of the amino acid sequence of Cas9 of *S. pyogenes, S. thermophilus, S. mutans* or *L. innocua;*
differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans,* or *L. innocua;* or
is identical to amino acids 120-180 of the amino acid sequence of Cas9 of *S. pyogenes, S. thermophilus, S. mutans,* or *L. innocua.*

In one embodiment, a Cas9 molecule or Cas9 polypeptide comprises an amino acid sequence referred to as region 2:
having 50%, 55%, 60%, 65%, 70%, 75%, 80%, 85%, 90%, 95%, 96%, 97%, 98% or 99% homology with amino acids 360-480 of the amino acid sequence of Cas9 of *S. pyogenes, S. thermophilus, S. mutans,* or *L. innocua;*
differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans,* or *L. innocua;* or
is identical to amino acids 360-480 of the amino acid sequence of Cas9 of *S. pyogenes, S. thermophilus, S. mutans,* or *L. innocua.*

In certain embodiments, a Cas9 molecule or Cas9 polypeptide comprises an amino acid sequence referred to as region 3:
having 55%, 60%, 65%, 70%, 75%, 80%, 85%, 90%, 95%, 96%, 97%, 98%, or 99% homology with amino acids 660-720 of the amino acid sequence of Cas9 of *S. pyogenes, S. thermophilus, S. mutans* or *L. innocua;*
differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua;* or
is identical to amino acids 660-720 of the amino acid sequence of Cas9 of *S. pyogenes, S. thermophilus, S. mutans* or *L. innocua.*

In one embodiment, a Cas9 molecule or Cas9 polypeptide comprises an amino acid sequence referred to as region 4:

having 50%, 55%, 60%, 65%, 70%, 75%, 80%, 85%, 90%, 95%, 96%, 97%, 98%, or 99% homology with amino acids 817-900 of the amino acid sequence of Cas9 of *S. pyogenes, S. thermophilus, S. mutans*, or *L. innocua*;

differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans*, or *L. innocua*; or is identical to amino acids 817-900 of the amino acid sequence of Cas9 of *S. pyogenes, S. thermophilus, S. mutans*, or *L. innocua*.

In one embodiment, a Cas9 molecule or Cas9 polypeptide comprises an amino acid sequence referred to as region 5:

having 50%, 55%, 60%, 65%, 70%, 75%, 80%, 85%, 90%, 95%, 96%, 97%, 98%, or 99% homology with amino acids 900-960 of the amino acid sequence of Cas9 of *S. pyogenes, S. thermophilus, S. mutans*, or *L. innocua*;

differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans*, or *L. innocua*; or is identical to amino acids 900-960 of the amino acid sequence of Cas9 of *S. pyogenes, S. thermophilus, S. mutans*, or *L. innocua*.

Engineered or Altered Cas9 Molecules and Cas9 Polypeptides

Cas9 molecules and Cas9 polypeptides described herein can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In certain embodiments, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double-strand nuclease activity). In one embodiment an engineered Cas9 molecule or Cas9 polypeptide can have an alteration that alters its size, e.g., a deletion of amino acid sequence that reduces its size, e.g., without significant effect on one or more, or any Cas9 activity. In one embodiment, an engineered Cas9 molecule or Cas9 polypeptide can comprise an alteration that affects PAM recognition. For example, an engineered Cas9 molecule can be altered to recognize a PAM sequence other than that recognized by the endogenous wild-type PI domain. In one embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In one embodiment, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental, Cas9 molecule.

In certain embodiments, a mutation or mutations do not have a substantial effect on a Cas9 activity, e.g., a Cas9 activity described herein. In other embodiments, a mutation or mutations have a substantial effect on a Cas9 activity, e.g., a Cas9 activity described herein.

Non-Cleaving and Modified-Cleavage Cas9 Molecules and Cas9 Polypeptides

In one embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single-strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

In certain embodiments, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In certain embodiments, an eaCas9 molecule or eaCas9 polypeptide comprises an active, or cleavage competent, HNH-like domain (e.g., an HNH-like domain described herein) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 10 of SEQ ID NO:2, e.g., can be substituted with an alanine. In one embodiment, the eaCas9 molecule or eaCas9 polypeptide differs from wild-type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes, S. aureus*, or *S. thermophilus*. In one embodiment, the reference Cas9 molecule is the naturally occurring Cas9 molecule having the closest sequence identity or homology.

In certain embodiments, an eaCas9 molecule or eaCas9 polypeptide comprises an inactive, or cleavage incompetent, HNH domain and an active, or cleavage competent, N-terminal RuvC-like domain (e.g., a RuvC-like domain described herein). Exemplary inactive, or cleavage incompetent HNH-like domains can have a mutation at one or more of: a histidine in an HNH-like domain, for example, at position 856 of the *S. pyogenes* Cas9 sequence (SEQ ID NO:2), e.g., can be substituted with an alanine; and one or more asparagines in an HNH-like domain, for example, at position 870 and/or 879 of the *S. pyogenes* Cas9 sequence (SEQ ID NO:2) e.g., can be substituted with an alanine. In one embodiment, the eaCas9 differs from wild-type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes, S. aureus*, or *S. thermophilus*. In one embodiment, the reference Cas9 molecule is the naturally occurring Cas9 molecule having the closest sequence identity or homology.

In certain embodiments, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In one embodiment, a mutation(s) is present in a RuvC domain. In one embodiment, a mutation(s) is present in an HNH domain. In one embodiment, mutations are present in both a RuvC domain and an HNH domain.

Exemplary mutations that may be made in the RuvC domain or HNH domain with reference to the *S. pyogenes* Cas9 sequence include: D10A, E762A, H840A, N854A, N863A and/or D986A. Exemplary mutations that may be made in the RuvC domain with reference to the *S. aureus* Cas9 sequence include N580A.

In one embodiment, a Cas9 molecule is an eiCas9 molecule comprising one or more differences in a RuvC domain and/or in an HNH domain as compared to a reference Cas9 molecule, and the eiCas9 molecule does not cleave a nucleic acid, or cleaves with significantly less efficiency than does wild type, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative. In one embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In one embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of *S. aureus* or *S. pyogenes* as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S. aureus* or *S. pyogenes*); its ability to modulate, e.g., decreased or increased, cleavage of a single-strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S. aureus* or *S. pyogenes*); or the ability to cleave a nucleic acid molecule, e.g., a double stranded or single stranded nucleic acid molecule, can be eliminated. In certain embodiments, the nickase is *S. aureus* Cas9-derived nickase comprising the sequence of SEQ ID NO: 484 (D10A) or SEQ ID NO: 485 (N580A) (Friedland 2015).

In certain embodiments, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In one embodiment, the altered Cas9 molecule is an eiCas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of *S. pyogenes, S. thermophilus, S. aureus, C. jejuni* or *N. meningitidis*. In one embodiment, the reference Cas9 molecule is the naturally occurring Cas9 molecule having the closest sequence identity or homology. In one embodiment, the eiCas9 molecule lacks substantial cleavage activity associated with a RuvC domain and cleavage activity associated with an HNH domain.

In certain embodiments, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of *S. pyogenes* comprising an N-terminal RuvC-like domain can be fused to a fragment of Cas9 molecule of a species other than *S. pyogenes* (e.g., *S. thermophilus*) comprising an HNH-like domain.

Cas9 with Altered or No PAM Recognition

Naturally-occurring Cas9 molecules can recognize specific PAM sequences, for example the PAM recognition sequences described above for, e.g., *S. pyogenes, S. thermophilus, S. mutans*, and *S. aureus*.

In certain embodiments, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes in order to decrease off-target sites and/or improve specificity; or eliminate a PAM recognition requirement. In certain embodiments, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), e.g., to decrease off-target sites and/or increase specificity. In certain embodiments, the length of the PAM recognition sequence is at least 4, 5, 6, 7, 8, 9, 10 or 15 amino acids in length. In one embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described (see, e.g., Esvelt 2011). Candidate Cas9 molecules can be evaluated, e.g., by methods described below.

Size-Optimized Cas9 Molecules

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a S. aureus or S. pyogenes Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which In one embodiment is the presence of two nickase activities; an endonuclease activity; an exonuclease activity; a helicase activity, i.e., the ability to unwind the helical structure of a double stranded nucleic acid; and recognition activity of a nucleic acid molecule, e.g., a target nucleic acid or a gRNA molecule.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species can be modeled onto the crystal structure of S. pyogenes Cas9 (Nishimasu 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

Nucleic Acids Encoding Cas9 Molecules

Nucleic acids encoding the Cas9 molecules or Cas9 polypeptides, e.g., an eaCas9 molecule or eaCas9 polypeptides are provided herein. Exemplary nucleic acids encoding Cas9 molecules or Cas9 polypeptides have been described previously (see, e.g., Cong 2013; Wang 2013; Mali 2013; Jinek 2012).

In one embodiment, a nucleic acid encoding a Cas9 molecule or Cas9 polypeptide can be a synthetic nucleic acid sequence. For example, the synthetic nucleic acid molecule can be chemically modified, e.g., as described herein. In one embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

An exemplary codon optimized nucleic acid sequence encoding a Cas9 molecule of S. pyogenes is set forth in SEQ ID NO: 22. The corresponding amino acid sequence of an S. pyogenes Cas9 molecule is set forth in SEQ ID NO: 23.

Exemplary codon optimized nucleic acid sequence encoding a Cas9 molecule of S. aureus is set forth in SEQ ID NO: 26, 39, 482 and 483.

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the embodiments disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) have been described previously (see, e.g., Haft 2005; Makarova 2011). Exemplary Cas molecules (and Cas systems) are also shown in Table 5.

TABLE 5

| | | Cas Systems | | | |
|---|---|---|---|---|---|
| Gene name[‡] | System type or subtype | Name from Haft 2005[§] | Structure of encoded protein (PDB accessions)[¶] | Families (and superfamily) of encoded protein[#]** | Representatives |
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |

TABLE 5-continued

Cas Systems

| Gene name[‡] | System type or subtype | Name from Haft 2005[§] | Structure of encoded protein (PDB accessions)[¶] | Families (and superfamily) of encoded protein[#,**] | Representatives |
|---|---|---|---|---|---|
| cas3' | Type I[‡‡] | cas3 | NA | COG1203 | APE1232 and ygcB |
| cas3" | Subtype I-A Subtype I-B | NA | NA | COG2254 | APE1231 and BH0336 |
| cas4 | Subtype I-A Subtype I-B Subtype I-C Subtype I-D Subtype II-B | cas4 and csa1 | NA | COG1468 | APE1239 and BH0340 |
| cas5 | Subtype I-A Subtype I-B Subtype I-C Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A Subtype I-B Subtype I-D Subtype III-A Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A Subtype I-B Subtype I-C Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy1046 |
| cas10 | Type III[‡‡] | cmr2, csm1 and csx11 | NA | COG1353 | MTH326, Rv2823c[§§] and TM1794[§§] |
| cas10d | Subtype I-D[‡‡] | csc3 | NA | COG1353 | slr7011 |
| csy1 | Subtype I-F[‡‡] | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E[‡‡] | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A[‡‡] | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype IIIB | cmr4 | NA | COG1336 (RAMP) | PF1126 |
| cmr5 | Subtype III-B[‡‡] | cmr5 | 2ZOP and 2OEB | COG3337 | MTH324 and PF1125 |
| cmr6 | Subtype III-B | cmr6 | NA | COG1604 (RAMP) | PF1124 |

TABLE 5-continued

Cas Systems

| Gene name‡ | System type or subtype | Name from Haft 2005§ | Structure of encoded protein (PDB accessions)¶ | Families (and superfamily) of encoded protein#** | Representatives |
|---|---|---|---|---|---|
| csb1 | Subtype I-U | GSU0053 | NA | (RAMP) | Balac_1306 and GSU0053 |
| csb2 | Subtype I-U§§ | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

V. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule have been described previously (Jinek 2012). Each technique described herein may be used alone or in combination with one or more techniques to evaluate the candidate molecule. The techniques disclosed herein may be used for a variety of methods including, without limitation, methods of determining the stability of a Cas9 molecule/gRNA molecule complex, methods of determining a condition that promotes a stable Cas9 molecule/gRNA molecule complex, methods of screening for a stable Cas9 molecule/gRNA molecule complex, methods of identifying an optimal gRNA to form a stable Cas9 molecule/gRNA molecule complex, and methods of selecting a Cas9/gRNA complex for administration to a subject.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 µL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 µL. Reactions are initiated by the addition of 1 µl target DNA (10 nM) and incubated for 1 h at 37° C. Reactions are quenched by the addition of 20 µL of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA have been described previously (Jinek 2012).

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated H₂O. Eluted DNA is ethanol precipitated and dissolved in DEPC-treated H₂O. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM MgCl₂, 1 mM DTT and 10% glycerol in a total volume of 10 µL. Cas9 protein molecule is programmed with equimolar amounts of pre-annealed gRNA molecule and titrated from 100 pM to 1 µM. Radiolabeled DNA is added to a final concentration of 20 pM. Samples are incubated for 1 h at 37° C. and resolved at 4° C. on an 8% native polyacrylamide gel containing 1×TBE and 5 mM MgCl₂. Gels are dried and DNA visualized by phosphorimaging.

Techniques for Measuring Thermostability of Cas9/gRNA Complexes

The thermostability of Cas9-gRNA ribonucleoprotein (RNP) complexes can be detected by differential scanning fluorimetry (DSF) and other techniques. The thermostability of a protein can increase under favorable conditions such as the addition of a binding RNA molecule, e.g., a gRNA. Thus, information regarding the thermostability of a Cas9/gRNA complex is useful for determining whether the complex is stable.

Differential Scanning Fluorimetry (DSF)

DSF is a technique that may be used to measure the thermostability of a protein. The assay can be applied in a number of ways. Exemplary protocols include, but are not limited to, a protocol to determine the desired solution conditions for RNP formation (assay 1, see below), a protocol to test the desired stoichiometric ratio of gRNA:Cas9 protein (assay 2, see below), a protocol to screen for effective gRNA molecules for Cas9 molecules, e.g., wild-type or mutant Cas9 molecules (assay 3, see below), and a protocol to examine RNP formation in the presence of target DNA (assay 4).

Assay 1

To determine the desired solution to form RNP complexes, a 2 µM solution of Cas9 is made in water with 10×SYPRO Orange® (Life Technologies Cat #S-6650) and dispensed into a 384 well plate. An equimolar amount of gRNA diluted in solutions with varied pH and salt is then added. After incubating at room temperature for 10 minutes and centrifugation at 2000 rpm to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

Assay 2

The second assay includes mixing various concentrations of gRNA molecules with 2 µM Cas9 in the buffer from assay 1 above and incubating at RT for 10 minutes in a 384 well plate. An equal volume of optimal buffer with 10×SYPRO Orange® (Life Technologies cat #S-6650) is added and the plate is sealed with Microseal® B adhesive (MSB-1001). Following centrifugation at 2000 rpm to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

Assay 3

In the third assay, a Cas9 molecule (e.g., a Cas9 protein, e.g., a Cas9 variant protein) of interest is purified. A library of variant gRNA molecules is synthesized and resuspended to a concentration of 20 µM. The Cas9 molecule is incubated with the gRNA molecule at a final concentration of 1 µM each in a predetermined buffer in the presence of 5×SYPRO Orange® (Life Technologies Cat #S-6650). After incubating at room temperature for 10 minutes and centrifugation at 2000 rpm for 2 minutes to remove any bubbles, a Bio-Rad CFX384™ Real-Time System C1000 Touch™ Thermal Cycler with the Bio-Rad CFX Manager software is used to run a gradient from 20° C. to 90° C. with an increase of 1° C. in temperature every 10 seconds.

Assay 4

In the fourth assay, a DSF experiment is performed with the following samples: Cas9 protein alone, Cas9 protein with gRNA, Cas9 protein with gRNA and target DNA, and Cas9 protein with target DNA. The order of mixing components is: reaction solution, Cas9 protein, gRNA, DNA, and SYPRO Orange. The reaction solution contains 10 mM HEPES pH 7.5, 100 mM NaCl, in the absence or presence of MgCl2. Following centrifugation at 2000 rpm for 2 minutes to remove any bubbles, a Bio-Rad CFX384™ Real-Time System C1000 Touch™ Thermal Cycler with the Bio-Rad CFX Manager software is used to run a gradient from 20° C. to 90° C. with a 10 increase in temperature every 10 seconds.

VI. Genome Editing Approaches

Mutations in a target gene may be corrected using one of the approaches discussed herein. In one embodiment, a mutation in a target gene is corrected by homology directed repair (HDR) using an exogenously provided template nucleic acid (see Section V.1), referred to herein as "gene correction". In another embodiment, a mutation in a target gene is corrected by homology directed repair without using an exogenously provided template nucleic acid (see Section V.1), referred to herein as gene correction.

V.1 HDR Repair and Template Nucleic Acids

In certain embodiments of the methods provided herein, HDR-mediated sequence alteration is used to alter and/or correct (e.g., repair or edit) the sequence of one or more nucleotides in a genome. While not wishing to be bound by theory, it is believed that HDR-mediated alteration of a target sequence within a target gene occurs by HDR with an exogenously provided donor template or template nucleic acid in a process referred to herein as gene correction. For example, the donor template or template nucleic acid provides for alteration of the target sequence. It is contemplated that a plasmid donor can be used as a template for homologous recombination. It is further contemplated that a single stranded donor template can be used as a template for alteration of the target sequence by alternate methods of HDR (e.g., single-strand annealing) between the target sequence and the donor template. Donor template-effected alteration of a target sequence depends on cleavage by a Cas9 molecule. Cleavage by Cas9 can comprise a double-strand break or two single-strand breaks.

In other embodiments, HDR-mediated sequence alteration is used to alter and/or correct (e.g., repair or edit) the sequence of one or more nucleotides in a target sequence in a genome without the use of an exogenously provided donor template or template nucleic acid. While not wishing to be bound by theory, it is believed that alteration of the target sequence occurs by HDR with endogenous genomic donor sequence, in a process referred to herein as gene conversion. For example, the endogenous genomic donor sequence provides for alteration of the target sequence. It is contemplated that in one embodiment the endogenous genomic donor sequence is located on the same chromosome as the target sequence. It is further contemplated that in another embodiment the endogenous genomic donor sequence is located on a different chromosome from the target sequence. Alteration of a target sequence by endogenous genomic donor sequence depends on cleavage by a Cas9 molecule. Cleavage by Cas9 can comprise a double-strand break or two single-strand breaks.

In one embodiment, the target position or target position regions has at least 50%, 60%, 70%, 80%, 81%, 82%, 83%, 84%, 85%, 86%, 87%, 88%, 89%, 90%, 91%, 92%, 93%, 94%, 95%, 96%, 97%, 98%, or 99% homology with an endogenous homologous sequence.

In one embodiment, the target position region, except for the target position, differs by 1, 2, 3, 4, 5, 10, 25, 50, 100 or fewer, nucleotides with an endogenous homologous sequence.

In one embodiment, the target position region has at least 50%, 60%, 70%, 80%, 90%, 92%, 94%, 96%, 98%, or 99% homology with an endogenous homologous sequence over at least 10, 20, 30, 40, 50, 100, 200, 300, 400, 500, 750, 1,000, 2500, 5000, or 10000 nucleotides.

In one embodiment, the target position region, except for the target position, differs by 1, 2, 3, 4, 5, 10, 25, 50, 100 or fewer, nucleotides with an endogenous homologous sequence over at least 10, 20, 30, 40, 50, 100, 200, 300, 400, 500, 750, 1,000, 2500, 5000, or 10000 nucleotides.

In one embodiment, the endogenous homologous sequence comprises a domain, e.g., a catalytic domain, a domain that binds a target, a structural domain, found in the gene that comprises the target position.

In certain embodiments of the methods provided herein, HDR-mediated alteration is used to alter a single nucleotide in a target sequence. These embodiments may utilize either one double-strand break or two single-strand breaks. In certain embodiments, a single nucleotide alteration is incorporated using (1) one double-strand break, (2) two single-strand breaks, (3) two double-strand breaks with a break occurring on each side of the target position, (4) one double-strand break and two single-strand breaks with the double-strand break and two single-strand breaks occurring on each side of the target position (5) four single-strand breaks with a pair of single stranded breaks occurring on each side of the target position, or (6) one single-strand break.

In certain embodiments wherein a single-stranded template nucleic acid is used, the target position can be altered by alternative HDR.

Donor template-effected alteration of a target position depends on cleavage by a Cas9 molecule. Cleavage by Cas9 can comprise a nick, a double-strand break, or two single-strand breaks, e.g., one on each strand of the target nucleic acid. After introduction of the breaks on the target nucleic acid, resection occurs at the break ends resulting in single stranded overhanging DNA regions.

In canonical HDR, a double-stranded donor template is introduced, comprising homologous sequence to the target nucleic acid that will either be directly incorporated into the target nucleic acid or used as a template to change the sequence of the target nucleic acid. After resection at the break, repair can progress by different pathways, e.g., by the double Holliday junction model (or double-strand break repair, DSBR, pathway) or the synthesis-dependent strand annealing (SDSA) pathway. In the double Holliday junction model, strand invasion by the two single stranded overhangs of the target nucleic acid to the homologous sequences in the donor template occurs, resulting in the formation of an intermediate with two Holliday junctions. The junctions migrate as new DNA is synthesized from the ends of the invading strand to fill the gap resulting from the resection. The end of the newly synthesized DNA is ligated to the resected end, and the junctions are resolved, resulting in the alteration of the target nucleic acid, e.g., incorporation of the altered sequence of the donor template at the corresponding target position. Crossover with the donor template may occur upon resolution of the junctions. In the SDSA pathway, only one single stranded overhang invades the donor template and new DNA is synthesized from the end of the invading strand to fill the gap resulting from resection. The newly synthesized DNA then anneals to the remaining single stranded overhang, new DNA is synthesized to fill in the gap, and the strands are ligated to produce the altered DNA duplex.

In alternative HDR, a single-strand donor template, e.g., template nucleic acid, is introduced. A nick, single-strand break, or double-strand break at the target nucleic acid, for altering a desired target position, is mediated by a Cas9 molecule, e.g., described herein, and resection at the break occurs to reveal single stranded overhangs. Incorporation of the sequence of the template nucleic acid to correct or alter the target position of the target nucleic acid typically occurs by the SDSA pathway, as described above.

Additional details on template nucleic acids are provided in Section IV entitled "Template nucleic acids" in International Application PCT/US2014/057905, published as WO 2015/048577, the entire contents of which are expressly incorporated herein by reference.

In certain embodiments, double-strand cleavage is effected by a Cas9 molecule having cleavage activity associated with an HNH-like domain and cleavage activity associated with a RuvC-like domain, e.g., an N-terminal RuvC-like domain, e.g., a wild type Cas9. Such embodiments require only a single gRNA molecule.

In certain embodiments, one single-strand break, or nick, is effected by a Cas9 molecule having nickase activity, e.g., a Cas9 nickase as described herein. A nicked target nucleic acid can be a substrate for alt-HDR.

In other embodiments, two single-strand breaks, or nicks, are effected by a Cas9 molecule having nickase activity, e.g., cleavage activity associated with an HNH-like domain or cleavage activity associated with an N-terminal RuvC-like domain. Such embodiments usually require two gRNAs, one for placement of each single-strand break. In one embodiment, the Cas9 molecule having nickase activity cleaves the strand to which the gRNA hybridizes, but not the strand that is complementary to the strand to which the gRNA hybridizes. In one embodiment, the Cas9 molecule having nickase activity does not cleave the strand to which the gRNA hybridizes, but rather cleaves the strand that is complementary to the strand to which the gRNA hybridizes.

In certain embodiments, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In other embodiments, a Cas9 molecule having an N863 mutation, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA). In other embodiments, a Cas9 molecule having an N580 mutation, e.g., the N580A mutation, can be used as a nickase. N580A inactivates HNH therefore the Cas9 nickase has (only) RuvC activity and cuts on the non-complementary strand (the strand that has the NGG PAM and whose sequence is identical to the gRNA).

In certain embodiments, in which a nickase and two gRNAs are used to position two single-strand nicks, one nick is on the + strand and one nick is on the − strand of the target nucleic acid. The PAMs can be outwardly facing or inwardly facing. The gRNAs can be selected such that the gRNAs are separated by, from about 0-50, 0-100, or 0-200 nucleotides. In one embodiment, there is no overlap between the target sequences that are complementary to the targeting domains of the two gRNAs. In one embodiment, the gRNAs do not overlap and are separated by as much as 50, 100, or 200 nucleotides. In one embodiment, the use of two gRNAs can increase specificity, e.g., by decreasing off-target binding (Ran 2013).

In certain embodiments, a single nick can be used to induce HDR, e.g., alt-HDR. It is contemplated herein that a single nick can be used to increase the ratio of HR to NHEJ at a given cleavage site. In certain embodiments, a single-strand break is formed in the strand of the target nucleic acid to which the targeting domain of said gRNA is complementary. In certain embodiments, a single-strand break is formed in the strand of the target nucleic acid other than the strand to which the targeting domain of said gRNA is complementary.

Placement of Double-Strand or Single-Strand Breaks Relative to the Target Position A double-strand break or single-strand break in one of the strands should be sufficiently close to target position that an alteration is produced in the desired region, e.g., correction of a mutation occurs. In certain embodiments, the distance is not more than 50, 100, 200, 300, 350 or 400 nucleotides. While not wishing to be bound by theory, in certain embodiments, it is believed that the break should be sufficiently close to target position such that the target position is within the region that is subject to exonuclease-mediated removal during end resection. If the distance between the target position and a break is too great, the sequence desired to be altered may not be included in the end resection and, therefore, may not be altered, as donor sequence, either exogenously provided donor sequence or endogenous genomic donor sequence, in some embodiments is only used to alter sequence within the end resection region.

In certain embodiments, the gRNA targeting domain is configured such that a cleavage event, e.g., a double-strand or single-strand break, is positioned within 1, 2, 3, 4, 5, 10, 15, 20, 25, 30, 35, 40, 45, 50, 60, 70, 80, 90, 100, 150 or 200 nucleotides of the region desired to be altered, e.g., a mutation. The break, e.g., a double-strand or single-strand break, can be positioned upstream or downstream of the region desired to be altered, e.g., a mutation. In some embodiments, a break is positioned within the region desired to be altered, e.g., within a region defined by at least two mutant nucleotides. In some embodiments, a break is positioned immediately adjacent to the region desired to be altered, e.g., immediately upstream or downstream of a mutation.

In certain embodiments, a single-strand break is accompanied by an additional single-strand break, positioned by a second gRNA molecule, as discussed below. For example, the targeting domains bind configured such that a cleavage event, e.g., the two single-strand breaks, are positioned within 1, 2, 3, 4, 5, 10, 15, 20, 25, 30, 35, 40, 45, 50, 60, 70, 80, 90, 100, 150 or 200 nucleotides of a target position. In one embodiment, the first and second gRNA molecules are configured such that when guiding a Cas9 nickase, a single-strand break is accompanied by an additional single-strand break, positioned by a second gRNA, sufficiently close to one another to result in alteration of the desired region. In one embodiment, the first and second gRNA molecules are configured such that a single-strand break positioned by said second gRNA is within 10, 20, 30, 40, or 50 nucleotides of the break positioned by said first gRNA molecule, e.g., when the Cas9 is a nickase. In one embodiment, the two gRNA molecules are configured to position cuts at the same position, or within a few nucleotides of one another, on different strands, e.g., essentially mimicking a double-strand break.

In certain embodiments, in which a gRNA (unimolecular (or chimeric) or modular gRNA) and Cas9 nuclease induce a double-strand break for the purpose of inducing HDR-mediated alteration, the cleavage site is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In certain embodiments, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In certain embodiments, one can promote HDR by using nickases to generate a break with overhangs. While not wishing to be bound by theory, the single stranded nature of the overhangs can enhance the cell's likelihood of repairing the break by HDR as opposed to, e.g., NHEJ. Specifically, in certain embodiments, HDR is promoted by selecting a first gRNA that targets a first nickase to a first target sequence, and a second gRNA that targets a second nickase to a second target sequence which is on the opposite DNA strand from the first target sequence and offset from the first nick.

In certain embodiment, the targeting domain of a gRNA molecule is configured to position a cleavage event sufficiently far from a preselected nucleotide, e.g., the nucleotide of a coding region, such that the nucleotide is not altered. In certain embodiments, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In certain embodiments, a double-strand break can be accompanied by an additional double-strand break, positioned by a second gRNA molecule, as is discussed below.

In certain embodiments, a double-strand break can be accompanied by two additional single-strand breaks, positioned by a second gRNA molecule and a third gRNA molecule.

In certain embodiments, a first and second single-strand breaks can be accompanied by two additional single-strand breaks positioned by a third gRNA molecule and a fourth gRNA molecule.

When two or more gRNAs are used to position two or more cleavage events, e.g., double-strand or single-strand breaks, in a target nucleic acid, it is contemplated that the two or more cleavage events may be made by the same or different Cas9 proteins. For example, when two gRNAs are used to position two double stranded breaks, a single Cas9 nuclease may be used to create both double stranded breaks. When two or more gRNAs are used to position two or more single stranded breaks (nicks), a single Cas9 nickase may be used to create the two or more nicks. When two or more gRNAs are used to position at least one double stranded break and at least one single stranded break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double stranded versus a single stranded break at the desired position in the target nucleic acid.

In some embodiments, the targeting domain of the first gRNA molecule and the targeting domain of the second gRNA molecules are complementary to opposite strands of the target nucleic acid molecule. In some embodiments, the gRNA molecule and the second gRNA molecule are configured such that the PAMs are oriented outward. In some embodiments, the gRNA molecule and the second gRNA molecule are configured such that the PAMs are oriented inward.

In certain embodiments, two gRNA are selected to direct Cas9-mediated cleavage at two positions that are a preselected distance from each other. In certain embodiments, the two points of cleavage are on opposite strands of the target nucleic acid. In some embodiments, the two cleavage points form a blunt ended break, and in other embodiments, they are offset so that the DNA ends comprise one or two overhangs (e.g., one or more 5' overhangs and/or one or more 3' overhangs). In some embodiments, each cleavage event is a nick. In some embodiments, the nicks are close enough together that they form a break that is recognized by the double stranded break machinery (as opposed to being recognized by, e.g., the SSBr machinery). In certain embodiments, the nicks are far enough apart that they create an overhang that is a substrate for HDR, i.e., the placement of the breaks mimics a DNA substrate that has experienced some resection. For instance, in some embodiments the nicks are spaced to create an overhang that is a substrate for processive resection. In some embodiments, the two breaks are spaced within 25-65 nucleotides of each other. The two breaks may be, e.g., about 25, 30, 35, 40, 45, 50, 55, 60 or 65 nucleotides of each other. The two breaks may be, e.g., at least about 25, 30, 35, 40, 45, 50, 55, 60 or 65 nucleotides of each other. The two breaks may be, e.g., at most about 30, 35, 40, 45, 50, 55, 60 or 65 nucleotides of each other. In embodiments, the two breaks are about 25-30, 30-35, 35-40, 40-45, 45-50, 50-55, 55-60, or 60-65 nucleotides of each other.

In some embodiments, the break that mimics a resected break comprises a 3' overhang (e.g., generated by a DSB and a nick, where the nick leaves a 3' overhang), a 5' overhang (e.g., generated by a DSB and a nick, where the nick leaves a 5' overhang), a 3' and a 5' overhang (e.g., generated by three cuts), two 3' overhangs (e.g., generated by two nicks that are offset from each other), or two 5' overhangs (e.g., generated by two nicks that are offset from each other).

In certain embodiments, in which two gRNAs (independently, unimolecular (or chimeric) or modular gRNA) complexing with Cas9 nickases induce two single-strand breaks for the purpose of inducing HDR-mediated alteration (e.g., correction), the closer nick is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, or 75 to 100 bp) away from the target position and the two nicks will ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20, 10, or 5 bp away from each other). In certain embodiments, the cleavage site is between 0-100 bp (e.g., 0 to 75, 0 to 50, 0 to 25, 25 to 100, 25 to 75, 25 to 50, 50 to 100, 50 to 75, or 75 to 100 bp) away from the target position.

In some embodiments, two gRNAs, e.g., independently, unimolecular (or chimeric) or modular gRNA, are configured to position a double-strand break on both sides of a target position. In other embodiments, three gRNAs, e.g., independently, unimolecular (or chimeric) or modular gRNA, are configured to position a double-strand break (i.e., one gRNA complexes with a cas9 nuclease) and two single-strand breaks or paired single stranded breaks (i.e., two gRNAs complex with Cas9 nickases) on either side of the target position. In other embodiments, four gRNAs, e.g., independently, unimolecular (or chimeric) or modular gRNA, are configured to generate two pairs of single stranded breaks (i.e., two pairs of two gRNA molecules complex with Cas9 nickases) on either side of the target position. The double-strand break(s) or the closer of the two single-strand nicks in a pair will ideally be within 0-500 bp of the target position (e.g., no more than 450, 400, 350, 300, 250, 200, 150, 100, 50 or 25 bp from the target position). When nickases are used, the two nicks in a pair are, in certain embodiments, within 25-65 bp of each other (e.g., between 25 to 55, 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20, or 10 bp).

When two gRNAs are used to target Cas9 molecules to breaks, different combinations of Cas9 molecules are envisioned. In some embodiments, a first gRNA is used to target a first Cas9 molecule to a first target position, and a second gRNA is used to target a second Cas9 molecule to a second target position. In some embodiments, the first Cas9 molecule creates a nick on the first strand of the target nucleic acid, and the second Cas9 molecule creates a nick on the opposite strand, resulting in a double stranded break (e.g., a blunt ended cut or a cut with overhangs).

Different combinations of nickases can be chosen to target one single stranded break to one strand and a second single stranded break to the opposite strand. When choosing a combination, one can take into account that there are nickases having one active RuvC-like domain, and nickases having one active HNH domain. In certain embodiments, a RuvC-like domain cleaves the non-complementary strand of the target nucleic acid molecule. In certain embodiments, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In more detail, in some embodiments, a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, In some embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain will cleave the non-complementary strand and the Cas9 molecule with the HNH domain will cleave the complementary strand, resulting in a double stranded break.

Homology Arms of the Donor Template

A homology arm should extend at least as far as the region in which end resection may occur, e.g., in order to allow the resected single stranded overhang to find a complementary region within the donor template. The overall length could be limited by parameters such as plasmid size or viral packaging limits. In one embodiment, a homology arm does not extend into repeated elements, e.g., Alu repeats or LINE repeats.

Exemplary homology arm lengths include at least 50, 100, 250, 500, 750, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides.

Target position, as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction, of the target position. In one embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In one embodiment, the target position is within a target sequence (e.g., the sequence to which the gRNA binds). In one embodiment, a target position is upstream or downstream of a target sequence (e.g., the sequence to which the gRNA binds).

A template nucleic acid, as that term is used herein, refers to a nucleic acid sequence which can be used in conjunction with a Cas9 molecule and a gRNA molecule to alter the structure of a target position. In certain embodiments, the target nucleic acid is modified to have the some or all of the sequence of the template nucleic acid, typically at or near cleavage site(s). In one embodiment, the template nucleic acid is single stranded. In certain embodiments, the template nucleic acid is double stranded. In certain embodiments, the template nucleic acid is DNA, e.g., double stranded DNA. In other embodiments, the template nucleic acid is single stranded DNA. In certain embodiments, the template nucleic acid is encoded on the same vector backbone, e.g., AAV genome, plasmid DNA, as the Cas9 and gRNA. In one embodiment, the template nucleic acid is excised from a vector backbone in vivo, e.g., it is flanked by gRNA recognition sequences. In certain embodiments, the template nucleic acid comprises endogenous genomic sequence.

In certain embodiments, the template nucleic acid alters the structure of the target position by participating in an HDR event. In certain embodiments, the template nucleic acid alters the sequence of the target position. In certain embodiments, the template nucleic acid results in the incorporation of a modified, or non-naturally occurring base into the target nucleic acid.

Typically, the template sequence undergoes a breakage mediated or catalyzed recombination with the target sequence. In certain embodiments, the template nucleic acid includes sequence that corresponds to a site on the target sequence that is cleaved by an eaCas9 mediated cleavage event. In certain embodiments, the template nucleic acid includes sequence that corresponds to both, a first site on the target sequence that is cleaved in a first Cas9 mediated event, and a second site on the target sequence that is cleaved in a second Cas9 mediated event.

In one embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a gene can be used to alter the structure of a target sequence (e.g., to correct a mutation present in a target position of an endogenous gene). The template sequence can be used to alter an unwanted structure, e.g., an unwanted or mutant nucleotide.

A template nucleic acid typically comprises the following components:

[5' homology arm]-[replacement sequence]-[3' homology arm].

The homology arms provide for recombination into the chromosome, thus replacing the undesired element, e.g., a mutation or signature, with the replacement sequence. In certain embodiments, the homology arms flank the most distal cleavage sites.

In certain embodiments, the 3' end of the 5' homology arm is the position next to the 5' end of the replacement sequence. In one embodiment, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In certain embodiments, the 5' end of the 3' homology arm is the position next to the 3' end of the replacement sequence. In certain embodiments, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In certain embodiments, to alter one or more nucleotides at a target position (e.g., to correct a mutation), the homology arms, e.g., the 5' and 3' homology arms, may each comprise about 1000 bp of sequence flanking the most distal gRNAs (e.g., 1000 bp of sequence on either side of the target position (e.g., the mutation).

It is contemplated herein that one or both homology arms may be shortened to avoid including certain sequence repeat elements, e.g., Alu repeats or LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for altering the sequence (e.g., correcting a mutation) of a target position may be designed for use as a single-stranded oligonucleotide, e.g., a single-stranded oligodeoxynucleotide (ssODN). When using a ssODN, 5' and 3' homology arms may range up to about 200 bp in length, e.g., at least 25, 50, 75, 100, 125, 150, 175, or 200 bp in length. Longer homology arms are also contemplated for ssODNs as improvements in oligonucleotide synthesis continue to be made. In some embodiments, a longer homology arm is made by a method other than chemical synthesis, e.g., by denaturing a long double stranded nucleic acid and purifying one of the strands, e.g., by affinity for a strand-specific sequence anchored to a solid substrate.

While not wishing to be bound by theory, in certain embodiments alt-HDR proceeds more efficiently when the template nucleic acid has extended homology 5' to the nick (i.e., in the 5' direction of the nicked strand). Accordingly, in some embodiments, the template nucleic acid has a longer homology arm and a shorter homology arm, wherein the longer homology arm can anneal 5' of the nick. In some embodiments, the arm that can anneal 5' to the nick is at least 25, 50, 75, 100, 125, 150, 175, or 200, 300, 400, 500, 600, 700, 800, 900, 1000, 1500, 2000, 3000, 4000, or 5000 nucleotides from the nick or the 5' or 3' end of the replacement sequence. In some embodiments, the arm that can anneal 5' to the nick is at least 10%, 20%, 30%, 40%, or 50% longer than the arm that can anneal 3' to the nick. In some embodiments, the arm that can anneal 5' to the nick is at least 2×, 3×, 4×, or 5× longer than the arm that can anneal 3' to the nick. Depending on whether a ssDNA template can anneal to the intact strand or the nicked strand, the homology arm that anneals 5' to the nick may be at the 5' end of the ssDNA template or the 3' end of the ssDNA template, respectively.

Similarly, in some embodiments, the template nucleic acid has a 5' homology arm, a replacement sequence, and a 3' homology arm, such that the template nucleic acid has extended homology to the 5' of the nick. For example, the 5' homology arm and 3' homology arm may be substantially the same length, but the replacement sequence may extend farther 5' of the nick than 3' of the nick. In some embodiments, the replacement sequence extends at least 10%, 20%, 30%, 40%, 50%, 2×, 3×, 4×, or 5× further to the 5' end of the nick than the 3' end of the nick.

While not wishing to be bound by theory, In some embodiments, alt-HDR proceeds more efficiently when the template nucleic acid is centered on the nick. Accordingly, in some embodiments, the template nucleic acid has two homology arms that are essentially the same size. For instance, the first homology arm of a template nucleic acid may have a length that is within 10%, 9%, 8%, 7%, 6%, 5%, 4%, 3%, 2%, or 1% of the second homology arm of the template nucleic acid.

Similarly, in some embodiments, the template nucleic acid has a 5' homology arm, a replacement sequence, and a 3' homology arm, such that the template nucleic acid extends substantially the same distance on either side of the nick. For example, the homology arms may have different lengths, but the replacement sequence may be selected to compensate for this. For example, the replacement sequence may extend further 5' from the nick than it does 3' of the nick, but the homology arm 5' of the nick is shorter than the homology arm 3' of the nick, to compensate. The converse is also possible, e.g., that the replacement sequence may extend further 3' from the nick than it does 5' of the nick, but the homology arm 3' of the nick is shorter than the homology arm 5' of the nick, to compensate.

Exemplary Template Nucleic Acids

In a preferred embodiment, and in order to increase DNA repair via gene conversion, the template nucleic acid is an endogenous homologous region. In certain embodiments, the template nucleic acid is double stranded. In other embodiments, the template nucleic acid is single stranded. In certain embodiments, the template nucleic acid comprises a single stranded portion and a double stranded portion. In certain embodiments, the template nucleic acid comprises about 50 to 100, e.g., 55 to 95, 60 to 90, 65 to 85, or 70 to 80 bp, homology on either side of the nick and/or replacement sequence. In certain embodiments, the template nucleic acid comprises about 50, 55, 60, 65, 70, 75, 80, 85, 90, 95, or 100 bp homology 5' of the nick or replacement sequence, 3' of the nick or replacement sequence, or both 5' and 3' of the nick or replacement sequences.

In certain embodiments, the template nucleic acid comprises about 150 to 200 bp, e.g., 155 to 195, 160 to 190, 165 to 185, or 170 to 180 bp, homology 3' of the nick and/or replacement sequence. In certain embodiments, the template nucleic acid comprises about 150, 155, 160, 165, 170, 175, 180, 185, 190, 195, or 200 bp homology 3' of the nick or replacement sequence. In some embodiments, the template nucleic acid comprises less than about 100, 90, 80, 70, 60, 50, 40, 30, 20, 15, or 10 bp homology 5' of the nick or replacement sequence.

In certain embodiments, the template nucleic acid comprises about 150 to 200 bp, e.g., 155 to 195, 160 to 190, 165 to 185, or 170 to 180 bp, homology 5' of the nick and/or replacement sequence. In certain embodiments, the template nucleic acid comprises about 150, 155, 160, 165, 170, 175, 180, 185, 190, 195, or 200 bp homology 5' of the nick or replacement sequence. In certain embodiments, the template nucleic acid comprises less than about 100, 90, 80, 70, 60, 50, 40, 30, 20, 15, or 10 bp homology 3' of the nick or replacement sequence.

In certain embodiments, the template nucleic acid comprises a nucleotide sequence, e.g., of one or more nucleotides, that will be added to or will template a change in the target nucleic acid. In other embodiments, the template nucleic acid comprises a nucleotide sequence that may be used to modify the target position. In other embodiments, the template nucleic acid comprises a nucleotide sequence, e.g., of one or more nucleotides, that corresponds to wild type sequence of the target nucleic acid, e.g., of the target position.

The template nucleic acid may comprise a replacement sequence. In some embodiments, the template nucleic acid comprises a 5' homology arm. In some embodiments, the template nucleic acid comprises a 3' homology arm.

In certain embodiments, the template nucleic acid is linear double stranded DNA. The length may be, e.g., about 150-200 bp, e.g., about 150, 160, 170, 180, 190, or 200 bp.

The length may be, e.g., at least 150, 160, 170, 180, 190, or 200 bp. In some embodiments, the length is no greater than 150, 160, 170, 180, 190, or 200 bp. In some embodiments, a double stranded template nucleic acid has a length of about 160 bp, e.g., about 155-165, 150-170, 140-180, 130-190, 120-200, 110-210, 100-220, 90-230, or 80-240 bp.

The template nucleic acid can be linear single stranded DNA. In certain embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the plus strand of the target nucleic acid, (iv) linear single stranded DNA that can anneal to the minus strand of the target nucleic acid, or more than one of the preceding. The length may be, e.g., about 150-200 nucleotides, e.g., about 150, 160, 170, 180, 190, or 200 nucleotides. The length may be, e.g., at least 150, 160, 170, 180, 190, or 200 nucleotides. In some embodiments, the length is no greater than 150, 160, 170, 180, 190, or 200 nucleotides. In some embodiments, a single stranded template nucleic acid has a length of about 160 nucleotides, e.g., about 155-165, 150-170, 140-180, 130-190, 120-200, 110-210, 100-220, 90-230, or 80-240 nucleotides.

In some embodiments, the template nucleic acid is circular double stranded DNA, e.g., a plasmid. In some embodiments, the template nucleic acid comprises about 500 to 1000 bp of homology on either side of the replacement sequence and/or the nick. In some embodiments, the template nucleic acid comprises about 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 bp of homology 5' of the nick or replacement sequence, 3' of the nick or replacement sequence, or both 5' and 3' of the nick or replacement sequence.

In certain embodiments, one or both homology arms may be shortened to avoid including certain sequence repeat elements, e.g., Alu repeats, LINE elements. For example, a 5' homology arm may be shortened to avoid a sequence repeat element, while a 3' homology arm may be shortened to avoid a sequence repeat element. In some embodiments, both the 5' and the 3' homology arms may be shortened to avoid including certain sequence repeat elements.

In some embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In some embodiments, the template nucleic acid comprises about 150 to 1000 nucleotides of homology on either side of the replacement sequence and/or the nick. In some embodiments, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In some embodiments, the template nucleic acid is a lentiviral vector, e.g., an IDLV (integration deficiency lentivirus). In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 bp of homology 5' of the nick or replacement sequence, 3' of the nick or replacement sequence, or both 5' and 3' of the nick or replacement sequence.

In one embodiment, the template nucleic acid comprises one or more mutations, e.g., silent mutations, that prevent Cas9 from recognizing and cleaving the template nucleic acid. The template nucleic acid may comprise, e.g., at least 1, 2, 3, 4, 5, 10, 20, 30, 40, or 50 silent mutations relative to the corresponding sequence in the genome of the cell to be altered. In certain embodiments, the template nucleic acid comprises at most 2, 3, 4, 5, 10, 20, 30, 40, or 50 silent mutations relative to the corresponding sequence in the genome of the cell to be altered. In one embodiment, the template nucleic acid comprises one or more mutations, e.g., silent mutations that prevent Cas9 from recognizing and cleaving the template nucleic acid. The template nucleic acid may comprise, e.g., at least 1, 2, 3, 4, 5, 10, 20, 30, 40, or 50 silent mutations relative to the corresponding sequence in the genome of the cell to be altered. In certain embodiments, the template nucleic acid comprises at most 2, 3, 4, 5, 10, 20, 30, 40, or 50 silent mutations relative to the corresponding sequence in the genome of the cell to be altered.

In certain embodiments, the template nucleic acid alters the structure of the target position by participating in an HDR event. In some embodiments, the template nucleic acid alters the sequence of the target position. In some embodiments, the template nucleic acid results in the incorporation of a modified, or non-naturally occurring nucleotide base into the target nucleic acid.

Typically, the template sequence undergoes a breakage mediated or catalyzed recombination with the target sequence. In some embodiments, the template nucleic acid includes sequence that corresponds to a site on the target sequence that is cleaved by an eaCas9 mediated cleavage event. In some embodiments, the template nucleic acid includes sequence that corresponds to both, a first site on the target sequence that is cleaved in a first Cas9 mediated event, and a second site on the target sequence that is cleaved in a second Cas9 mediated event.

In some embodiments, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introduction of a stop codon, insertion of an amino acid residue, deletion of an amino acid residue, or a nonsense mutation.

In some embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter or enhancer, or an alteration in a cis-acting or trans-acting control element.

In some embodiments, a template nucleic acid having homology with a target position can be used to alter the structure of a target sequence. The template nucleic acid sequence can be used to alter an unwanted structure, e.g., an unwanted or mutant nucleotide.

In certain embodiments, the length of the 5' homology arm is about 5 to about 100 nucleotides. In some embodiments, the length of the 5' homology arm is about 10 to about 150 nucleotides. In some embodiments, the length of the 5' homology arm is about 20 to about 150 nucleotides. In certain embodiments, the length of the 5' homology arm is about 10, 20, 50, 100, 150, 200, 250, 300, 350, 400, 450, 500, 550, 600, 650, 700, 750, 800, 850, 900, 950, 1000, 1100, 1200, or more nucleotides in length.

In certain embodiments, the length of the 3' homology arm is about 5 to about 100 nucleotides. In some embodiments, the length of the 3' homology arm is about 10 to about 150 nucleotides. In some embodiments, the length of the 3' homology arm is about 20 to about 150 nucleotides. In certain embodiments, the length of the 3' homology arm is about 10, 20, 50, 100, 150, 200, 250, 300, 350, 400, 450, 500, 550, 600, 650, 700, 750, 800, 850, 900, 950, 1000, 1100, 1200, or more nucleotides in length.

It is contemplated herein that one or both homology arms may be shortened to avoid including certain sequence repeat elements, e.g., Alu repeats, LINE elements. For example, a 5' homology arm may be shortened to avoid a sequence repeat element. In one embodiment, a 3' homology arm may be shortened to avoid a sequence repeat element. In one embodiment, both the 5' and the 3' homology arms may be shortened to avoid including certain sequence repeat elements. In some embodiments, the length of the 5' homology arm is at least 50 nucleotides in length, but not long enough to include a repeated element. In some embodiments, the length of the 5' homology arm is at least 100 nucleotides in length, but not long enough to include a repeated element. In some embodiments, the length of the 5' homology arm is at least 150 nucleotides in length, but not long enough to include a repeated element. In some embodiments, the length of the 3' homology arm is at least 50 nucleotides in length, but not long enough to include a repeated element. In some embodiments, the length of the 3' homology arm is at least 100 nucleotides in length, but not long enough to include a repeated element. In some embodiments, the length of the 3' homology arm is at least 150 nucleotides in length, but not long enough to include a repeated element.

It is contemplated herein that template nucleic acids for correcting a mutation may be designed for use as a single-stranded oligonucleotide (ssODN), e.g., a single-stranded oligodeoxynucleotide. When using a ssODN, 5' and 3' homology arms may range up to about 200 bp in length, e.g., at least 25, 50, 75, 100, 125, 150, 175, or 200 bp in length. Longer homology arms are also contemplated for ssODNs as improvements in oligonucleotide synthesis continue to be made.

Silent Mutations in the Template Nucleic Acid

It is contemplated herein that Cas9 could potentially cleave donor constructs either prior to or following homology directed repair (e.g., homologous recombination), resulting in a possible non-homologous-end-joining event and further DNA sequence mutation at the chromosomal locus of interest. Therefore, to avoid cleavage of the donor sequence before and/or after Cas9-mediated homology directed repair, in some embodiments, alternate versions of the donor sequence may be used where silent mutations are introduced. These silent mutations may disrupt Cas9 binding and cleavage, but not disrupt the amino acid sequence of the repaired gene.

V.2 NHEJ Approaches for Gene Targeting

In certain embodiments of the methods provided herein, NHEJ-mediated deletion is used to delete all or part of a target gene. As described herein, nuclease-induced NHEJ can also be used to remove (e.g., delete) sequences in a gene of interest.

While not wishing to be bound by theory, it is believed that, in certain embodiments, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, e.g., resection, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but can be greater than 100-200 bp. In some embodiments, the deletion is at least about 1, 2, 3, 4, 5, 6, 7, 8, 9, 10, 11, 12, 13, 14, 15, 16, 17, 18, 19, 20, 30, 40, 47, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, 1000000 or more bp in length. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double-strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Placement of Double-Strand or Single-Strand Breaks Relative to the Target Position In certain embodiments, in which a gRNA and Cas9 nuclease generate a double-strand break for the purpose of inducing NHEJ-mediated indels, a gRNA, e.g., a unimolecular (or chimeric) or modular gRNA molecule, is configured to position one double-strand break in close proximity to a nucleotide of the target position. In one embodiment, the cleavage site is between 0-30 bp away from the target position (e.g., less than 30, 25, 20, 15, 10, 9, 8, 7, 6, 5, 4, 3, 2 or 1 bp from the target position).

In certain embodiments, in which two gRNAs complexing with Cas9 nickases induce two single-strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In certain embodiments, the gRNAs are configured to position cuts at the same position, or within a few nucleotides of one another, on different strands, essentially mimicking a double-strand break. In certain embodiments, the closer nick is between 0-30 bp away from the target position (e.g., less than 30, 25, 20, 15, 10, 9, 8, 7, 6, 5, 4, 3, 2, or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp). In certain embodiments, the gRNAs are configured to place a single-strand break on either side of a nucleotide of the target position.

Both double-strand cleaving eaCas9 molecules and single strand, or nickase, eaCas9 molecules can be used in the methods and compositions described herein to generate breaks both sides of a target position. Double-strand or paired single-strand breaks may be generated on both sides of a target position to remove the nucleic acid sequence between the two cuts (e.g., the region between the two breaks in deleted). In certain embodiments, two gRNAs, e.g., independently, unimolecular (or chimeric) or modular gRNA, are configured to position a double-strand break on both sides of a target position. In other embodiments, three gRNAs, e.g., independently, unimolecular (or chimeric) or modular gRNA, are configured to position a double-strand break (i.e., one gRNA complexes with a Cas9 nuclease) and two single-strand breaks or paired single-strand breaks (i.e., two gRNAs complex with Cas9 nickases) on either side of the target position. In certain embodiments, four gRNAs, e.g., independently, unimolecular (or chimeric) or modular gRNA, are configured to generate two pairs of single-strand breaks (i.e., two pairs of two gRNAs complex with Cas9 nickases) on either side of the target position. The double-strand break(s) or the closer of the two single-strand nicks in a pair will ideally be within 0-500 bp of the target position (e.g., no more than 450, 400, 350, 300, 250, 200, 150, 100, 50, or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp).

V.3 Targeted Knockdown

Unlike CRISPR/Cas-mediated gene knockout, which permanently eliminates expression by mutating the gene at the DNA level, CRISPR/Cas9 knockdown allows for temporary reduction of gene expression through the use of artificial transcription factors. Mutating key residues in both DNA cleavage domains of the Cas9 molecule (e.g., the D10A and H840A mutations) results in the generation of a catalytically inactive Cas9 (referred to herein as "eiCas9", which is also known as dead Cas9 or dCas9) molecule. An eiCas9 complexes with a gRNA and localizes to the DNA sequence specified by that gRNA's targeting domain, however, it does not cleave the target DNA. Fusion of the eiCas9 to an effector domain, e.g., a transcription repression domain, enables recruitment of the effector to any DNA site specified by the gRNA. Although an eiCas9 itself can block transcription when recruited to early regions in the coding sequence, more robust repression can be achieved by fusing a transcriptional repression domain (for example KRAB, SID or ERD) to the eiCas9, referred to herein as a "Cas9-repressor", and recruiting the transcriptional repression domain to the target knockdown position, e.g., within 1000 bp of sequence 3' of the start codon or within 500 bp of a promoter region 5' of the start codon of a gene. It is likely that targeting DNAse I hypersensitive sites (DHSs) of the promoter may yield more efficient gene repression or activation because these regions are more likely to be accessible to the eiCas9 and are also more likely to harbor sites for endogenous transcription factors. Especially for gene repression, it is contemplated herein that blocking the binding site of an endogenous transcription factor would aid in downregulating gene expression. In certain embodiments, one or more eiCas9 molecules may be used to block binding of one or more endogenous transcription factors. In some embodiments, an eiCas9 molecule can be fused to a chromatin modifying protein. Altering chromatin status can result in decreased expression of the target gene. One or more eiCas9 molecules fused to one or more chromatin modifying proteins may be used to alter chromatin status.

In one embodiment, a gRNA molecule can be targeted to a known transcription response elements (e.g., promoters, enhancers, etc.), a known upstream activating sequences (UAS), and/or sequences of unknown or known function that are suspected of being able to control expression of the target DNA.

CRISPR/Cas-mediated gene knockdown can be used to reduce expression of an unwanted allele or transcript. Contemplated herein are scenarios wherein permanent destruction of the gene is not ideal. In these scenarios, site-specific repression may be used to temporarily reduce or eliminate expression. It is also contemplated herein that the off-target effects of a Cas9-repressor may be less severe than those of a Cas9-nuclease as a nuclease can cleave any DNA sequence and cause mutations whereas a Cas9-repressor may only have an effect if it targets the promoter region of an actively transcribed gene. However, while nuclease-mediated knockout is permanent, repression may only persist as long as the Cas9-repressor is present in the cells. Once the repressor is no longer present, it is likely that endogenous transcription factors and gene regulatory elements would restore expression to its natural state.

V.4 Single-Strand Annealing

Single-strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single-strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

V.5 Other DNA Repair Pathways

SSBR (Single-Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott 2008, and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are damaged. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Polβ, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase β, DNA polymerase delta, DNA polymerase epsilon, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li 2008, and a summary is provided here.

Mismatch repair (MMR) operates on mispaired DNA bases.

The MSH2/6 or MSH2/3 complexes both have ATPase activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutLt which possesses an ATPase activity and is important for multiple steps of MMR. It possesses a PCNA/replication factor C (RFC)-dependent endonuclease activity which plays an important role in 3' nick-directed MMR involving EXO1 (EXO1 is a participant in both HR and MMR). It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol delta, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott 2008, and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends;

(d) insertion of the desired nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incises the phosphodiester backbone to create a DNA single-strand break (SSB). The third step of BER involves cleaning-up of the DNA ends. The fourth step in BER is conducted by Pol β that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polβ, Pol delta, Pol epsilon, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al. 2014, and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1, and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA pol ζ and Rev1.

Error-free postreplication repair (PRR) is another pathway for repairing a single stranded break left after a defective replication event.

V.6 Examples of gRNAs in Genome Editing Methods gRNA molecules as described herein can be used with Cas9 molecules that generate a double-strand break or a single-strand break to alter the sequence of a target nucleic acid, e.g., a target position or target genetic signature. gRNA molecules useful in these methods are described below.

In certain embodiments, the gRNA, e.g., a chimeric gRNA, is configured such that it comprises one or more of the following properties;

a) it can position, e.g., when targeting a Cas9 molecule that makes double-strand breaks, a double-strand break (i) within 50, 100, 150, 200, 250, 300, 350, 400, 450, or 500 nucleotides of a target position, or (ii) sufficiently close that the target position is within the region of end resection;

b) it has a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and (c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, N. meningitidis,* or *S. aureus,* tail and proximal domain, or a sequence that differs by no more than 1, 2, 3, 4, 5, 6, 7, 8, 9, or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, N. meningitidis,* or *S. aureus* gRNA, or a sequence that differs by no more than 1, 2, 3, 4, 5, 6, 7, 8, 9, or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, N. meningitidis,* or *S. aureus* gRNA, or a sequence that differs by no more than 1, 2, 3, 4, 5, 6, 7, 8, 9, or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes* or *S. aureus* tail domain, or a sequence that differs by no more than 1, 2, 3, 4, 5, 6, 7, 8, 9, or 10 nucleotides therefrom; or (c)(v) the tail domain comprises 15, 20, 25, 30, 35, 40 nucleotides or all of the corresponding portions of a naturally occurring tail domain, e.g., a naturally occurring *S. pyogenes, S. thermophilus, N. meningitidis,* or *S. aureus* tail domain.

In certain embodiments, the gRNA is configured such that it comprises properties a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(ii), and c(i); a(i), b(ii), and c(ii); a(i), b(iii), and c(i); a(i), b(iii), and c(ii); a(i), b(iv), and c(i); a(i), b(iv), and c(ii); a(i), b(v), and c(i); a(i), b(v), and c(ii); a(i), b(vi), and c(i); a(i), b(vi), and c(ii); a(i), b(vii), and c(i); a(i), b(vii), and c(ii); a(i), b(viii), and c(i); a(i), b(viii), and c(ii); a(i), b(ix), and c(i); a(i), b(ix), and c(ii); a(i), b(x), and c(i); a(i), b(x), and c(ii); a(i), b(xi), or c(i); a(i), b(xi), and c(ii).

In certain embodiments, the gRNA, e.g., a chimeric gRNA, is configured such that it comprises one or more of the following properties:

(a) one or both of the gRNAs can position, e.g., when targeting a Cas9 molecule that makes single-strand breaks, a single-strand break within (i) 50, 100, 150, 200, 250, 300, 350, 400, 450, or 500 nucleotides of a target position, or (ii) sufficiently close that the target position is within the region of end resection;

(b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and (c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, N. meningitidis,* or *S. aureus* tail and proximal domain, or a sequence that differs by no more than 1, 2, 3, 4, 5, 6, 7, 8, 9, or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, N. meningitidis,* or *S. aureus* gRNA, or a sequence that differs by no more than 1, 2, 3, 4, 5, 6, 7, 8, 9, or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, N. meningitidis,* or *S. aureus* gRNA, or a sequence that differs by no more than 1, 2, 3, 4, 5, 6, 7, 8, 9, or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, N. meningitidis,* or *S. aureus* tail domain, or a sequence that differs by no more than 1, 2, 3, 4, 5, 6, 7, 8, 9, or 10 nucleotides therefrom; or (c)(v) the tail domain comprises 15, 20, 25, 30, 35, 40 nucleotides or all of the corresponding portions of a naturally occurring tail domain, e.g., a naturally occurring *S. pyogenes, S. thermophilus, N. meningitidis,* or *S. aureus* tail domain.

In certain embodiments, the gRNA is configured such that it comprises properties: a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(ii), and c(i); a(i), b(ii), and c(ii); a(i), b(iii), and c(i); a(i), b(iii), and c(ii); a(i), b(iv), and c(i); a(i), b(iv), and c(ii); a(i), b(v), and c(i); a(i), b(v), and c(ii); a(i), b(vi), and c(i); a(i), b(vi), and c(ii); a(i), b(vii), and c(i); a(i), b(vii), and c(ii); a(i), b(viii), and c(i); a(i), b(viii), and c(ii); a(i), b(ix), and c(i); a(i), b(ix), and c(ii); a(i), b(x), and c(i); a(i), b(x), and c(ii); a(i), b(xi), and c(i); or a(i), b(xi), and c(ii).

In certain embodiments, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In one embodiment, the gRNA is used with a Cas9 nickase molecule having RuvC activity, e.g., a Cas9 molecule having the HNH activity inactivated, e.g., a Cas9 molecule having a mutation at 840, e.g., the H840A.

In one embodiment, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

In one embodiment, the gRNAs are used with a Cas9 nickase molecule having RuvC activity, e.g., a Cas9 molecule having the HNH activity inactivated, e.g., a Cas9 molecule having a mutation at N580, e.g., the N580A mutation.

In embodiment, a pair of gRNAs, e.g., a pair of chimeric gRNAs, comprising a first and a second gRNA, is configured such that they comprises one or more of the following properties:

a) one or both of the gRNA molecules can position, e.g., when targeting a Cas9 molecule that makes single-strand breaks, a single-strand break within (i) 50, 100, 150, 200, 250, 300, 350, 400, 450, or 500 nucleotides of a target position, or (ii) sufficiently close that the target position is within the region of end resection;

b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides;

(c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, N. meningitidis,* or *S. aureus* tail and proximal domain, or a sequence that differs by no more than 1, 2, 3, 4, 5, 6, 7, 8, 9, or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, N. meningitidis,* or *S. aureus* gRNA, or a sequence that differs by no more than 1, 2, 3, 4, 5, 6, 7, 8, 9, or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, N. meningitidis,* or *S. aureus* gRNA, or a sequence that differs by no more than 1, 2, 3, 4, 5, 6, 7, 8, 9, or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S.*

*pyogenes, S. thermophilus, N. meningitidis,* or *S. aureus* tail domain; or, or a sequence that differs by no more than 1, 2, 3, 4, 5, 6, 7, 8, 9, or 10 nucleotides therefrom; or (c)(v) the tail domain comprises 15, 20, 25, 30, 35, or 40 nucleotides or all of the corresponding portions of a naturally occurring tail domain, e.g., a naturally occurring *S. pyogenes, S. thermophilus, N. meningitidis,* or *S. aureus* tail domain;

(d) the gRNAs are configured such that, when hybridized to target nucleic acid, they are separated by 0-50, 0-100, 0-200, at least 10, at least 20, at least 30 or at least 50 nucleotides;

(e) the breaks made by the first gRNA and second gRNA are on different strands; and (f) the PAMs are facing outwards.

In certain embodiments, one or both of the gRNAs is configured such that it comprises properties a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(i), c, and d; a(i), b(i), c, and e; a(i), b(i), c, d, and e; a(i), b(ii), and c(i); a(i), b(ii), and c(ii); a(i), b(ii), c, and d; a(i), b(ii), c, and e; a(i), b(ii), c, d, and e; a(i), b(iii), and c(i); a(i), b(iii), and c(ii); a(i), b(iii), c, and d; a(i), b(iii), c, and e; a(i), b(iii), c, d, and e; a(i), b(iv), and c(i); a(i), b(iv), and c(ii); a(i), b(iv), c, and d; a(i), b(iv), c, and e; a(i), b(iv), c, d, and e; a(i), b(v), and c(i); a(i), b(v), and c(ii); a(i), b(v), c, and d; a(i), b(v), c, and e; a(i), b(v), c, d, and e; a(i), b(vi), and c(i); a(i), b(vi), and c(ii); a(i), b(vi), c, and d; a(i), b(vi), c, and e; a(i), b(vi), c, d, and e; a(i), b(vii), and c(i); a(i), b(vii), and c(ii); a(i), b(vii), c, and d; a(i), b(vii), c, and e; a(i), b(vii), c, d, and e; a(i), b(viii), and c(i); a(i), b(viii), and c(ii); a(i), b(viii), c, and d; a(i), b(viii), c, and e; a(i), b(viii), c, d, and e; a(i), b(ix), and c(i); a(i), b(ix), and c(ii); a(i), b(ix), c, and d; a(i), b(ix), c, and e; a(i), b(ix), c, d, and e; a(i), b(x), and c(i); a(i), b(x), and c(ii); a(i), b(x), c, and d; a(i), b(x), c, and e; a(i), b(x), c, d, and e; a(i), b(xi), and c(i); a(i), b(xi), and c(ii); a(i), b(xi), c, and d; a(i), b(xi), c, and e; or a(i), b(xi), c, d, and e.

In certain embodiments, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In certain embodiments, the gRNAs are used with a Cas9 nickase molecule having RuvC activity, e.g., a Cas9 molecule having the HNH activity inactivated, e.g., a Cas9 molecule having a mutation at H840, e.g., the H840A mutation.

In certain embodiments, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

In certain embodiments, the gRNAs are used with a Cas9 nickase molecule having RuvC activity, e.g., a Cas9 molecule having the HNH activity inactivated, e.g., a Cas9 molecule having a mutation at N580, e.g., the N580A mutation.

VII. Stem Cells

Cas9 molecules, gRNA molecules (e.g., a Cas9 molecule/gRNA molecule complex), and optionally donor template nucleic acids, can be used to manipulate a cell, e.g., to edit a target nucleic acid, in a wide variety of cells. However, stem cells are particularly difficult to work with, and introduction of foreign molecules, such as Cas9 molecules and gRNA molecules, typically leads to a very high rate of cell death and low rate of cell survival. Accordingly, disclosed herein are methods which surprisingly provide increased chance of stem cell survival, and decreased rates of cell death, in response to exposure to CRISPR/Cas9 components.

In one embodiment, a cell is manipulated by editing (e.g., introducing a mutation in) a target gene as described herein. In one embodiment, a cell, or a population of cells, is manipulated by editing one or more non-coding sequences, e.g., an alteration in an intron or in a 5' or 3' non-translated or non-transcribed region. In one embodiment, a cell, or a population of cells, is manipulated by editing the sequence of a control element, e.g., a promoter, enhancer, or a cis-acting or trans-acting control element. In one embodiment, a cell, or a population of cells, is manipulated by editing one or more coding sequences, e.g., an alteration in an exon. In some embodiments, a cell, or a population of cells, is manipulated in vitro. In other embodiments, a cell, or a population of cells, is manipulated ex vivo. In some embodiments, a cell, or a population of cells, is manipulated in vivo. In some embodiments, the expression of one or more target genes (e.g., one or more target genes described herein) is modulated, e.g., in vivo. In other embodiments, the expression of one or more target genes (e.g., one or more target genes described herein) is modulated, e.g., ex vivo. In other embodiments, the expression of one or more target genes (e.g., one or more target genes described herein) is modulated, e.g., in vitro.

In one embodiment, a cell, or a population of cells, is manipulated by editing (e.g., inducing a mutation in) the target gene, e.g., as described herein. In one embodiment, the expression of the target gene is modulated, e.g., in vivo. In another embodiment, the expression of the target gene is modulated, e.g., ex vivo.

The Cas9, gRNA, and optionally donor template nucleic acid molecules described herein can be delivered to a stem cell. In certain embodiments, the stem cell is a hematopoietic stem/progenitor cell. In certain embodiments, hematopoietic stem/progenitor cells are preferentially targeted, e.g., at least about 90%, 95% 96%, 97%, 98%, 99%, or 100% of the targeted cells are hematopoietic stem/progenitor cells. For example, in the case of in vivo delivery, hematopoietic stem/progenitor cells are preferentially targeted, and if cells are treated ex vivo, and administered to the subject, hematopoietic stem/progenitor cells are preferentially modified. In certain embodiments, the stem cell is a circulating blood cell, e.g., a reticulocyte, a megakaryocyte erythroid progenitor (MEP) cell, a myeloid progenitor cell (CMP/GMP), a lymphoid progenitor (LP) cell, a hematopoietic stem/progenitor cell (HSC or HSPC), or an endothelial cell (EC). In certain embodiments, the HSC includes HSC progenitor cells. In certain embodiments, the HSC includes hematopoietic stem cells. In other embodiments, the HSC includes hematopoietic stem cell progenitor cells and hematopoietic stem cells. In certain embodiments, the stem cell is a bone marrow cell (e.g., a reticulocyte, an erythroid cell (e.g., an erythroblast), an MEP cell, a myeloid progenitor cell, a LP cell, an erythroid progenitor (EP) cell, a hematopoietic stem/progenitor cell, a multipotent progenitor (MPP) cell, an endothelial cell (EC), a hemogenic endothelial (HE) cell, a mesenchymal stem cell). In certain embodiments, the stem cell is a myeloid progenitor cell (e.g., a common myeloid progenitor (CMP) cell or a granulocyte macrophage progenitor (GMP) cell). In certain embodiments, the stem cell is a lymphoid progenitor cell, e.g., a common lymphoid progenitor (CLP) cell). In certain embodiments, the stem cell is an erythroid progenitor cell (e.g., a MEP cell). In certain embodiments, the stem cell is a hematopoietic stem/progenitor cell (e.g., a long term HSC (LT-HSC), a short term HSC (ST-HSC), a MPP cell, or a lineage restricted progenitor (LRP) cell). In certain embodiments, the stem cell is a $CD34^+$ cell, a $CD34^+CD90^+$ cell, a $CD34^+CD38^-$ cell, a $CD34^+CD90^+CD49f^+CD38^-CD45RA^-$ cell, a $CD105^+$ cell, a $CD31^+$, a $CD133^+$ cell, or a $CD34^+CD90^+CD133^+$ cell. In certain embodiments, the stem cell is an umbilical cord blood $CD34^+$ HSC, an umbilical cord venous endothelial cell, an umbilical cord arterial endothelial cell, an amniotic fluid $CD34^+$ cell, an amniotic fluid endothelial cell, a placental endothelial cell or a placental hematopoietic $CD34^+$ cell. In certain embodiments, the stem cell is a mobilized peripheral blood hematopoietic $CD34^+$ cell (after the patient is treated with a mobilization agent, e.g., G-CSF or Plerixafor). In certain embodiments, the stem cell is a peripheral blood endothelial cell.

In certain embodiments, the stem cell is manipulated ex vivo and administered to a subject. Sources of stem cells for ex vivo manipulation may include, for example, the subject's blood, cord blood, or bone marrow. Other sources of stem cells for ex vivo manipulation may include, for example, heterologous donor blood, cord blood, or bone marrow.

In certain embodiments, a cell disclosed herein is removed from a subject, manipulated ex vivo (e.g., by editing a gene) as described above, and the cell is returned to the subject. For example, in certain embodiments, a myeloid progenitor cell is removed from a subject, manipulated ex vivo (e.g., by editing a gene) as described above, and the myeloid progenitor cell is returned to the subject. In certain embodiments, an erythroid progenitor cell is removed from a subject, manipulated ex vivo as described above, and the erythroid progenitor cell is returned to the subject. In certain embodiments, a lymphoid progenitor cell is removed from a subject, manipulated ex vivo as described above, and the lymphoid progenitor cell is returned to the subject. In certain embodiments, a multipotent progenitor cell is removed from a subject, manipulated ex vivo as described above, and the hematopoietic stem cell is returned to the subject. In certain embodiments, a hematopoietic stem/progenitor cell is removed from a subject, manipulated ex vivo as described above, and the hematopoietic stem/progenitor cell is returned to the subject. In certain embodiments, a $CD34^+$ hematopoietic stem cell is removed from a subject, manipulated ex vivo as described above, and the $CD34^+$ hematopoietic stem/progenitor cell is returned to the subject.

In certain embodiments wherein modified HSCs generated ex vivo are administered to a subject without myeloablative pre-conditioning. In other embodiments, the modified HSCs are administered after mild myeloblative conditioning such that, followed engraftment, some of the hematopoietic cells are derived from the modified HSCs. In still other embodiments, the modified HSCs are administered after full myeloblation such that, following engraftment, 100% of the hematopoietic cells are derived from the modified HSCs. A suitable cell can also include a stem cell such as, for example, an embryonic stem cell, an induced pluripotent stem cell, a hematopoietic stem cell, a hemogenic endothelial (HE) cell (precursor to both hemptopoietic stem cells and endothelial cells), and a mesenchymal stem cell. In certain embodiments, the cell is an induced pluripotent stem (iPS) cell or a cell derived from an iPS cell, e.g., an iPS cell generated from the subject, modified using methods disclosed herein and differentiated into a clinically relevant cell such as a myeloid progenitor cell, a lymphoid progenitor cell, an erythroid progenitor cell, a multipotent progenitor cell, or a hematopoietic stem/progenitor cell. A suitable cell can also include an endothelial cell or amniotic cell that is differentiated into a hematopoietic stem cell.

In one embodiment, a viral vector is used to transduce the stem cell. In one embodiment, AAV (e.g., AAV6 and AAVDJ) is used to transduce the stem cell. In one embodiment, a lentivirus vector or an integration deficient lentivirus vector is used to transduce the stem cell. In one embodiment, a ribonucleic acid (e.g., a gRNA molecule and an mRNA encoding a Cas9 molecule) is used to transfect the stem cell. In one embodiment, a protein (e.g., a Cas9 molecule) and a ribonucleic acid (e.g., a gRNA molecule) are used to transfect the stem cell. In one embodiment, a ribonucleoprotein complex (e.g., a Cas9 molecule/gRNA molecule complex) is used to transfect the stem cell. In one embodiment, a deoxyribonucleic acid (e.g., a DNA encoding a gRNA molecule, a Cas9 molecule, or both) is used to transfect the stem cells.

Cells produced by the methods described herein may be used immediately. Alternatively, the cells may be frozen (e.g., in liquid nitrogen) and stored for later use. The cells will usually be frozen in 10% dimethylsulfoxide (DMSO), 50% serum, 40% buffered medium, or some other such solution as is commonly used in the art to preserve cells at such freezing temperature and thawed in such a manner as commonly known in the art for thawing frozen cultured cells. Cells may also be thermostabilized for prolonged storage (for example, at 4° C.).

VIII. Delivery, Formulations and Routes of Administration

The components, e.g., a Cas9 molecule and gRNA molecule (e.g., a Cas9 molecule/gRNA molecule complex), and a donor template nucleic acid, or all three, can be delivered, formulated, or administered in a variety of forms, see, e.g., Tables 6 and 7. In certain embodiments, one Cas9 molecule and two or more (e.g., 2, 3, 4, or more) different gRNA molecules are delivered, e.g., by an AAV vector. In certain embodiments, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is delivered encoded in DNA the DNA will typically include a control region, e.g., comprising a promoter, to effect expression. Useful promoters for Cas9 molecule sequences include CMV, SFFV, EFS, EF-1a, PGK, CAG, and CBH promoters, or a blood cell specific promoter. In an embodiment, the promoter is a constitutive promoter. In another embodiment, the promoter is a tissue specific promoter. Useful promoters for gRNAs include T7, H1, EF-1a, U6, U1, and tRNA promoters. Promoters with similar or dissimilar strengths can be selected to tune the expression of components. Sequences encoding a Cas9 molecule can comprise a nuclear localization signal (NLS), e.g., an SV40 NLS. In one embodiment, the sequence encoding a Cas9 molecule comprises at least two nuclear localization signals. In one embodiment, a promoter for a Cas9 molecule or a gRNA molecule can be, independently, inducible, tissue specific, or cell specific.

Table 6 provides examples of how the components can be formulated, delivered, or administered.

TABLE 6

| Cas9 Molecule(s) | gRNA Molecule(s) | Optional Donor Template Nucleic Acid | Comments |
|---|---|---|---|
| DNA | DNA | DNA | In this embodiment, a Cas9 molecule, typically an eaCas9 molecule, and a gRNA molecule are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA molecule are transcribed from DNA. In this embodiment, they are encoded on separate molecules. In this embodiment, the donor template is provided on the same DNA molecule that encodes the gRNA molecule. |
| | DNA | DNA | In this embodiment, a Cas9 molecule, typically an eaCas9 molecule, and a gRNA molecule are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA molecule are transcribed from DNA. In this embodiment, they are encoded on separate molecules. In this embodiment, the donor template is provided on the same DNA molecule that encodes the Cas9 molecule. |
| DNA | RNA | DNA | In this embodiment, a Cas9 molecule, typically an eaCas9 molecule, is transcribed from DNA, and a gRNA molecule is provided as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA molecule is provided as in vitro transcribed or synthesized RNA. In this embodiment, the donor template is provided on the same DNA molecule that encodes the Cas9 molecule. |
| mRNA | RNA | DNA | In this embodiment, a Cas9 molecule, typically an eaCas9 molecule, is translated from in vitro transcribed mRNA, and a gRNA molecule is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA molecule is transcribed from DNA. In this embodiment, the donor template is provided as a separate DNA molecule. |
| mRNA | | DNA | In this embodiment, a Cas9 molecule, typically an eaCas9 molecule, is translated from in vitro transcribed mRNA, and a gRNA molecule is transcribed from DNA. In this embodiment, the donor template is provided on the same DNA molecule that encodes the gRNA molecule. |
| Protein | DNA | DNA | In this embodiment, a Cas9 molecule, typically an eaCas9 molecule, is provided as a protein, and a gRNA molecule is transcribed from DNA. In this embodiment, the donor template is provided as a separate DNA molecule. |

TABLE 6-continued

| Elements | | | |
|---|---|---|---|
| Cas9 Molecule(s) | gRNA Molecule(s) | Optional Donor Template Nucleic Acid | Comments |
| Protein | | DNA | In this embodiment, a Cas9 molecule, typically an eaCas9 molecule, is provided as a protein, and a gRNA is transcribed from DNA. In this embodiment, the donor template is provided on the same DNA molecule that encodes the gRNA molecule. |
| Protein | RNA | DNA | In this embodiment, an eaCas9 molecule is provided as a protein, and a gRNA molecule is provided as transcribed or synthesized RNA. In this embodiment, the donor template is provided as a DNA molecule. |

Table 7 summarizes various delivery methods for the components of a Cas system, e.g., the Cas9 molecule component and the gRNA molecule component, as described herein.

TABLE 7

| | Delivery Vector/Mode | Delivery into Non-Dividing Cells | Duration of Expression | Genome Integration | Type of Molecule Delivered |
|---|---|---|---|---|---|
| | Physical (e.g., electroporation, particle gun, Calcium Phosphate transfection, cell compression or squeezing) | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Molecule and or One or More gRNA Molecules and/or a Donor Template Nucleic acids encoding Cas9 molecules (e.g., eaCas9 molecules), gRNA molecules, a donor template nucleic acid, or any combination (e.g., two or all) thereof, can be administered to subjects or delivered into cells by art-known methods or as described herein. For example, Cas9-encoding and/or gRNA-encoding DNA, as well as donor template nucleic acids can be delivered by, e.g., vectors (e.g., viral or non-viral vectors), non-vector based methods (e.g., using naked DNA or DNA complexes), or a combination thereof.

Nucleic acids encoding Cas9 molecules (e.g., eaCas9 molecules) and/or gRNA molecules can be conjugated to molecules (e.g., N-acetylgalactosamine) promoting uptake by the stem cells (e.g., HSCs). Donor template molecules can likewise be conjugated to molecules (e.g., N-acetylgalactosamine) promoting uptake by the stem cells (e.g., HSCs).

In some embodiments, the Cas9- and/or gRNA-encoding DNA is delivered by a vector (e.g., viral vector/virus or plasmid).

Vectors can comprise a sequence that encodes a Cas9 molecule and/or a gRNA molecule and/or a donor template with high homology to the region (e.g., target sequence) being targeted. In certain embodiments, the donor template comprises all or part of a target sequence. Exemplary donor templates are a repair template, e.g., a gene correction template, or a gene mutation template, e.g., point mutation (e.g., single nucleotide (nt) substitution) template. A vector can also comprise a sequence encoding a signal peptide (e.g., for nuclear localization, nucleolar localization, or mitochondrial localization), fused, e.g., to a Cas9 molecule sequence. For example, the vectors can comprise a nuclear localization sequence (e.g., from SV40) fused to the sequence encoding the Cas9 molecule.

One or more regulatory/control elements, e.g., promoters, enhancers, introns, polyadenylation signals, Kozak consensus sequences, and internal ribosome entry sites (IRES), can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In other embodiments, the promoter is a viral promoter. In some embodiments, the promoter is a non-viral promoter.

In some embodiments, the vector is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). In some embodiments, the virus infects dividing cells. In other embodiments, the virus infects non-dividing cells. Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In one embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the stem cell surface (e.g., a ligand-receptor, monoclonal antibody, avidin-biotin and chemical conjugation).

In some embodiments, the Cas9- and/or gRNA-encoding nucleic acid sequence is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted.

In an embodiment, the Cas9- and/or gRNA-encoding nucleic acid sequence is delivered by a recombinant lentivirus. In one embodiment, the donor template nucleic acid is delivered by a recombinant lentivirus. For example, the lentivirus is replication-defective, e.g., does not comprise one or more genes required for viral replication.

In some embodiments, the Cas9- and/or gRNA-encoding nucleic acid sequence is delivered by a recombinant adenovirus. In one embodiment, the donor template nucleic acid is delivered by a recombinant adenovirus. In some embodiments, the adenovirus is engineered to have reduced immunity in human.

In some embodiments, the Cas9- and/or gRNA-encoding nucleic acid sequence is delivered by a recombinant AAV. In one embodiment, the donor template nucleic acid is delivered by a recombinant AAV. In some embodiments, the AAV does not incorporate its genome into that of a host cell, e.g., a stem cell as describe herein. In some embodiments, the AAV can incorporate its genome into that of a host cell. In some embodiments, the AAV is a self-complementary adeno-associated virus (scAAV), e.g., a scAAV that packages both strands which anneal together to form double stranded DNA.

In one embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In one embodiment, the Cas9- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In one embodiment, the Cas9- and/or gRNA-encoding DNA is delivered by a chimeric AAV capsid. In one embodiment, the donor template nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9.

In one embodiment, the AAV is a self-complementary adeno-associated virus (scAAV), e.g., a scAAV that packages both strands which anneal together to form double stranded DNA.

In some embodiments, the Cas9- and/or gRNA-encoding DNA is delivered by a hybrid virus, e.g., a hybrid of one or more of the viruses described herein. In one embodiment, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a stem cell. Exemplary packaging cells include 293 cells, which can package adenovirus, and ψ2 or PA317 cells, which can package retrovirus. A viral vector used in gene therapy is usually generated by a producer cell line that packages a nucleic acid vector into a viral particle. The vector typically contains the minimal viral sequences required for packaging and subsequent integration into a host or stem cell (if applicable), with other viral sequences being replaced by an expression cassette encoding the protein to be expressed, e.g. Cas9. For example, an AAV vector used in gene therapy typically only possesses inverted terminal repeat (ITR) sequences from the AAV genome which are required for packaging and gene expression in the host or stem cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In certain embodiments, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In certain embodiments, the viral vector is capable of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, single chain antibody, or growth factor); and/or engineered to have a molecular bridge with dual specificities with one end recognizing a viral glycoprotein and the other end recognizing a moiety of the stem cell surface (e.g., ligand-receptor, monoclonal antibody, avidin-biotin and chemical conjugation).

In certain embodiments, the viral vector achieves cell type specific expression. For example, a tissue-specific promoter can be constructed to restrict expression of the transgene (Cas9 and gRNA) into only the stem cell. The specificity of the vector can also be mediated by microRNA-dependent control of transgene expression. In one embodiment, the viral vector has increased efficiency of fusion of the viral vector and a stem cell membrane. For example, a fusion protein such as fusion-competent hemagglutin (HA) can be incorporated to increase viral uptake into cells. In one embodiment, the viral vector has the ability of nuclear localization. For example, a virus that requires the breakdown of the nuclear envelope (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (see, e.g., Lee 2012), gene gun, sonoporation, magnetofection, lipid-mediated transfection, dendrimers, inorganic nanoparticles, calcium phosphates, or a combination thereof.

In one embodiment, delivery via electroporation comprises mixing the cells with the Cas9- and/or gRNA-encoding DNA in a cartridge, chamber or cuvette and applying one or more electrical impulses of defined duration and amplitude. In one embodiment, delivery via electroporation is performed using a system in which cells are mixed with the Cas9- and/or gRNA-encoding DNA in a vessel connected to a device (e.g., a pump) which feeds the mixture into a cartridge, chamber or cuvette wherein one or more electrical impulses of defined duration and amplitude are applied, after which the cells are delivered to a second vessel.

In some embodiments, the Cas9- and/or gRNA-encoding DNA is delivered by a combination of a vector and a non-vector based method. In one embodiment, the donor template nucleic acid is delivered by a combination of a vector and a non-vector based method. For example, virosomes combine liposomes with an inactivated virus (e.g., HIV or influenza virus), which can result in more efficient gene transfer, e.g., in respiratory epithelial cells than either viral or liposomal methods alone.

As described above, a nucleic acid may comprise (a) a sequence encoding a gRNA molecule comprising a targeting domain that is complementary with a target domain in a gene, and (b) a sequence encoding a Cas9 molecule. In one embodiment, (a) and (b) are present on the same nucleic acid molecule, e.g., the same vector, e.g., the same viral vector, e.g., the same adeno-associated virus (AAV) vector. In one embodiment, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector. In another embodiment, (a) is present on a first nucleic acid molecule, e.g., a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors. In yet another embodiment, the nucleic acid may further comprise (c) a sequence that encodes a second, third and/or fourth gRNA molecule as described herein. In one embodiment, the nucleic acid comprises (a), (b) and (c). Each of (a) and (c) may be present on the same nucleic acid molecule, e.g., the same vector, e.g., the same viral vector, e.g., the same adeno-associated virus (AAV) vector. In one embodiment, the nucleic acid molecule is an AAV vector.

In another embodiment, (a) and (c) are on different vectors. For example, (a) may be present on a first nucleic acid molecule, e.g., a first vector, e.g., a first viral vector, e.g., a first AAV vector; and (c) may be present on a second nucleic acid molecule, e.g., a second vector, e.g., a second vector, e.g., a second AAV vector. In one embodiment, the first and second nucleic acid molecules are AAV vectors. In yet another embodiment, each of (a), (b), and (c) are present on the same nucleic acid molecule, e.g., the same vector, e.g., the same viral vector, e.g., an AAV vector. In one embodiment, the nucleic acid molecule is an AAV vector. In an alternate embodiment, one of (a), (b), and (c) is encoded on a first nucleic acid molecule, e.g., a first vector, e.g., a first viral vector, e.g., a first AAV vector; and a second and third of (a), (b), and (c) is encoded on a second nucleic acid molecule, e.g., a second vector, e.g., a second vector, e.g., a second AAV vector. The first and second nucleic acid molecule may be AAV vectors.

In one embodiment, (a) is present on a first nucleic acid molecule, e.g., a first vector, e.g., a first viral vector, a first AAV vector; and (b) and (c) are present on a second nucleic acid molecule, e.g., a second vector, e.g., a second vector, e.g., a second AAV vector. The first and second nucleic acid molecule may be AAV vectors. In another embodiment, (b)

is present on a first nucleic acid molecule, e.g., a first vector, e.g., a first viral vector, e.g., a first AAV vector; and (a) and (c) are present on a second nucleic acid molecule, e.g., a second vector, e.g., a second vector, e.g., a second AAV vector. The first and second nucleic acid molecule may be AAV vectors.

In another embodiment, (c) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors.

In another embodiment, each of (a), (b) and (c) are present on different nucleic acid molecules, e.g., different vectors, e.g., different viral vectors, e.g., different AAV vector. For example, (a) may be on a first nucleic acid molecule, (b) on a second nucleic acid molecule, and (c) on a third nucleic acid molecule. The first, second and third nucleic acid molecule may be AAV vectors.

In another embodiment, when a third and/or fourth gRNA molecule are present, each of (a), (b), (c)(i), (c)(ii) and (c)(iii) may be present on the same nucleic acid molecule, e.g., the same vector, e.g., the same viral vector, e.g., an AAV vector. In one embodiment, the nucleic acid molecule is an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In further embodiments, each of (a), (b), (c)(i), (c)(ii) and (c)(iii) may be present on more than one nucleic acid molecule, but fewer than five nucleic acid molecules, e.g., AAV vectors.

In another embodiment, when (d) a template nucleic acid is present, each of (a), (b), and (d) may be present on the same nucleic acid molecule, e.g., the same vector, e.g., the same viral vector, e.g., an AAV vector. In one embodiment, the nucleic acid molecule is an AAV vector. In an alternate embodiment, each of (a), (b), and (d) may be present on the different nucleic acid molecules, e.g., different vectors, e.g., the different viral vectors, e.g., different AAV vectors. In further embodiments, each of (a), (b), and (d) may be present on more than one nucleic acid molecules, but fewer than three nucleic acid molecules, e.g., AAV vectors.

In another embodiment, when (d) a template nucleic acid is present, each of (a), (b), (c)(i) and (d) may be present on the same nucleic acid molecule, e.g., the same vector, e.g., the same viral vector, e.g., an AAV vector. In one embodiment, the nucleic acid molecule is an AAV vector. In an alternate embodiment, each of (a), (b), (c)(i) and (d) may be present on the different nucleic acid molecules, e.g., different vectors, e.g., the different viral vectors, e.g., different AAV vectors. In further embodiments, each of (a), (b), (c)(i) and (d) may be present on more than one nucleic acid molecule, but fewer than four nucleic acid molecules, e.g., AAV vectors.

In another embodiment, when (d) a template nucleic acid is present, each of (a), (b), (c)(i), (c)(ii) and (d) may be present on the same nucleic acid molecule, e.g., the same vector, e.g., the same viral vector, e.g., an AAV vector. In one embodiment, the nucleic acid molecule is an AAV vector. In an alternate embodiment, each of (a), (b), (c)(i), (c)(ii) and (d) may be present on the different nucleic acid molecules, e.g., different vectors, e.g., the different viral vectors, e.g., different AAV vectors. In further embodiments, each of (a), (b), (c)(i), (c)(ii) and (d) may be present on more than one nucleic acid molecule, but fewer than five nucleic acid molecules, e.g., AAV vectors.

In another embodiment, when (d) a template nucleic acid is present, each of (a), (b), (c)(i), (c)(ii), (c)(iii) and (d) may be present on the same nucleic acid molecule, e.g., the same vector, e.g., the same viral vector, e.g., an AAV vector. In one embodiment, the nucleic acid molecule is an AAV vector. In an alternate embodiment, each of (a), (b), (c)(i), (c)(ii), (c)(iii) and (d) may be present on the different nucleic acid molecules, e.g., different vectors, e.g., the different viral vectors, e.g., different AAV vectors. In further embodiments, each of (a), (b), (c)(i), (c)(ii), (c)(iii) and (d) may be present on more than one nucleic acid molecule, but fewer than six nucleic acid molecules, e.g., AAV vectors.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (c), e.g., a promoter described herein. The promoter and second promoter differ from one another. In one embodiment, the promoter and second promoter are the same.

The nucleic acids described herein may further comprise a promoter operably linked to the sequence that encodes the Cas9 molecule of (b), e.g., a promoter described herein.

In one embodiment, the delivery vehicle is a non-viral vector. In one embodiment, the non-viral vector is an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In one embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 8.

TABLE 8

Lipids Used for Gene Transfer

| Lipid | Abbreviation | Feature |
| --- | --- | --- |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)propyl],N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |

TABLE 8-continued

Lipids Used for Gene Transfer

| Lipid | Abbreviation | Feature |
|---|---|---|
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 9.

TABLE 9

Polymers Used for Gene Transfer

| Polymer | Abbreviation |
|---|---|
| Polyethyleneglycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |

TABLE 9-continued

Polymers Used for Gene Transfer

| Polymer | Abbreviation |
|---|---|
| Poly(2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In one embodiment, the vehicle has targeting modifications to increase stem cell update of nanoparticles and liposomes, e.g., cell specific antigens, monoclonal antibodies, single chain antibodies, aptamers, polymers, sugars (e.g., N-acetylgalactosamine (GalNAc)), and cell penetrating peptides. In one embodiment, the vehicle uses fusogenic and endosome-destabilizing peptides/polymers. In one embodiment, the vehicle undergoes acid-triggered conformational changes (e.g., to accelerate endosomal escape of the cargo). In one embodiment, a stimuli-cleavable polymer is used, e.g., for release in a cellular compartment. For example, disulfide-based cationic polymers that are cleaved in the reducing cellular environment can be used.

In one embodiment, the delivery vehicle is a biological non-viral delivery vehicle. In one embodiment, the vehicle is an attenuated bacterium (e.g., naturally or artificially engineered to be invasive but attenuated to prevent pathogenesis and expressing the transgene (e.g., *Listeria mono-*

*cytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In one embodiment, the vehicle is a genetically modified bacteriophage (e.g., engineered phages having large packaging capacity, less immunogenic, containing mammalian plasmid maintenance sequences and having incorporated targeting ligands). In one embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In one embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovesicle (30-100 nm) of endocytic origin (e.g., can be produced from various cell types and can therefore be taken up by cells without the need of for targeting ligands).

In one embodiment, one or more nucleic acid molecules (e.g., DNA molecules) other than the components of a Cas system, e.g., the Cas9 molecule component and/or the gRNA molecule component described herein, are delivered. In one embodiment, the nucleic acid molecule is delivered at the same time as one or more of the components of the Cas system are delivered. In one embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In one embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In one embodiment, the nucleic acid molecule encodes a therapeutic protein, e.g., a protein described herein. In one embodiment, the nucleic acid molecule encodes an RNA molecule, e.g., an RNA molecule described herein.

Delivery of RNA Encoding a Cas9 Molecule

RNA encoding Cas9 molecules and/or gRNA molecules, can be delivered into cells, e.g., stem cells described herein, by art-known methods or as described herein. For example, Cas9-encoding and/or gRNA-encoding RNA can be delivered, e.g., by microinjection, electroporation, transient cell compression or squeezing (see, e.g., Lee 2012), lipid-mediated transfection, peptide-mediated delivery, or a combination thereof. Cas9-encoding and/or gRNA-encoding RNA can be conjugated to molecules) promoting uptake by the stem cells (e.g., stem cells described herein).

In one embodiment, delivery via electroporation comprises mixing the cells with the RNA encoding Cas9 molecules and/or gRNA molecules, with or without donor template nucleic acid molecules, in a cartridge, chamber or cuvette and applying one or more electrical impulses of defined duration and amplitude. In one embodiment, delivery via electroporation is performed using a system in which cells are mixed with the RNA encoding Cas9 molecules and/or gRNA molecules, with or without donor template nucleic acid molecules in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the stem cells (e.g., stem cells described herein).

Delivery of Cas9

Cas9 molecules can be delivered into cells by art-known methods or as described herein. For example, Cas9 protein molecules can be delivered, e.g., by microinjection, electroporation, transient cell compression or squeezing (see, e.g., Lee 2012), lipid-mediated transfection, peptide-mediated delivery, or a combination thereof. Delivery can be accompanied by DNA encoding a gRNA or by a gRNA. Cas9 protein can be conjugated to molecules promoting uptake by the stem cells (e.g., stem cells described herein).

In one embodiment, delivery via electroporation comprises mixing the cells with the Cas9 molecules and/or gRNA molecules, with or without donor nucleic acid, in a cartridge, chamber or cuvette and applying one or more electrical impulses of defined duration and amplitude. In one embodiment, delivery via electroporation is performed using a system in which cells are mixed with the Cas9 molecules and/or gRNA molecules, with or without donor nucleic acid in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the stem cells (e.g., stem cells described herein).

A Cas9 protein can be combined with a gRNA molecule to form a ribonucleoprotein (RNP) complex to be administered to a subject or delivered into a cell by art-known methods or as described herein. Direct delivery of Cas9/gRNA RNP complex to cells eliminates the needs of expression from nucleic acid (e.g., transfection of plasmids encoding Cas9 and gRNA). It also eliminated unwanted integration of DNA segments derived from nucleic acid delivery (e.g., transfection of plasmids encoding Cas9 and gRNA). Therefore it is an alternative delivery approach which provide rapid action, fast turnover, high rate of on-target modification, reduced off target effect and less toxicity to cells. It can also be utilized to deliver the Cas9/gRNA complex to hard to transfect cells (e.g., hard to transfect primary and pluripotent stem cells). A Cas9/gRNA ribonucleoprotein (RNP) complex usually is formed prior to administration (i.e., pre-formed). When multiple (e.g., more than one) Cas9/gRNA ribonucleoprotein (RNP) complexes are involved, they can be delivered (e.g., administered) simultaneously or sequentially. In an embodiment, a Cas9/gRNA ribonucleoprotein (RNP) complexes can be delivered to cells by electroporation.

Route of Administration

Systemic modes of administration include oral and parenteral routes. Parenteral routes include, by way of example, intravenous, intramarrow, intrarterial, intramuscular, intradermal, subcutaneous, intranasal, and intraperitoneal routes. Components administered systemically may be modified or formulated to target a cell described herein, e.g., HSCs, or erythroid progenitor or precursor cells.

Local modes of administration include, by way of example, intramarrow injection into the trabecular bone, intrafemoral injection into the marrow space, or infusion into the portal vein. In one embodiment, significantly smaller amounts of the components (compared with systemic approaches) may exert an effect when administered locally (for example, directly into the bone marrow) compared to when administered systemically (for example, intravenously). Local modes of administration can reduce or eliminate the incidence of potentially toxic side effects that may occur when therapeutically effective amounts of a component are administered systemically.

Administration may be provided as a periodic bolus (e.g., intravenously) or as continuous infusion from an internal reservoir or from an external reservoir (for example, from an intravenous bag or implantable pump). Components may be administered locally, for example, by continuous release from a sustained release drug delivery device.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly(caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly(ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly(vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In one embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, template nucleic acid, or payload. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., AAV or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In one embodiment, a gRNA molecule can be delivered by such modes. The Cas9 molecule component can be delivered by a mode which results in less persistence or less exposure to the body or a particular compartment or tissue or organ.

More generally, In one embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In certain embodiments, the first pharmacodynamic or pharmacokinetic property, e.g., distribution, persistence or exposure, is more limited than the second pharmacodynamic or pharmacokinetic property.

In certain embodiments, the first mode of delivery is selected to optimize, e.g., minimize, a pharmacodynamic or pharmacokinetic property, e.g., distribution, persistence or exposure.

In certain embodiments, the second mode of delivery is selected to optimize, e.g., maximize, a pharmacodynamic or pharmacokinetic property, e.g., distribution, persistence or exposure.

In certain embodiments, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In certain embodiments, the second mode of delivery comprises a relatively transient element, e.g., an RNA or protein.

In certain embodiments, the first component comprises gRNA molecule, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and/or efficacy, e.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, In one embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In one embodiment the first mode comprises a first element selected from a liposome, nanoparticle, e.g., polymeric nanoparticle, and a nucleic acid, e.g., viral vector. The second mode comprises a second element selected from the group. In one embodiment, the first mode of delivery comprises a first targeting element, e.g., a cell specific receptor or an antibody, and the second mode of delivery does not include that element. In certain embodiments, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

In some embodiments, the CRISPR/Cas9 components are contacted with a stem cell via electroporation. Without wishing to be bound by theory, when electroporation is used to contact a CRISPR/Cas9 component with a stem cell, it may be particularly advantageous to cold-shock the cells for a transient period of time. As used herein, the term "cold-shock" or "cold-shocked" refers to the placement of a cell in a hypothermic environment as compared to the environment immediately preceding the treatment. In one embodiment, the cell is cold-shocked after an electroporation. In one embodiment, the cold shock temperature is between about 27° C. and about 33° C. In one embodiment, the cold shock temperature is 27, 28, 29, 30, 31, 32, or 33° C. In one embodiment, the cold shock temperature is about 30° C. to about 32° C.

Ex Vivo Delivery

In some embodiments, components described in Table 6 are introduced into cells which are then introduced into the subject. Methods of introducing the components can include, e.g., any of the delivery methods described in Table 7.

IX. Modified Nucleosides, Nucleotides, and Nucleic Acids

Modified nucleosides and modified nucleotides can be present in nucleic acids, e.g., particularly gRNA molecule, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In one embodiment, every base of a gRNA is modified, e.g., all bases have a modified phosphate group, e.g., all are phosphorothioate groups. In one embodiment, all, or substantially all, of the phosphate groups of a unimolecular (or chimeric) or modular gRNA molecule are replaced with phosphorothioate groups.

In one embodiment, modified nucleotides, e.g., nucleotides having modifications as described herein, can be incorporated into a nucleic acid, e.g., a "modified nucleic acid." In one embodiment, the modified nucleic acids comprise one, two, three or more modified nucleotides. In one embodiment, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In one embodiment, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In one embodiment, the modified nucleosides, modified nucleotides, and modified nucleic acids described herein can disrupt binding of a major groove interacting partner with the nucleic acid. In one embodiment, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In one embodiment, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications
Phosphate Group

In one embodiment, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In one embodiment, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In one embodiment, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In one embodiment, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In one embodiment, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In one embodiment, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In one embodiment, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In one embodiment, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In one embodiment, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g., L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In one embodiment, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In one embodiment, the nucleobase can include, for example, naturally-occurring and synthetic derivatives of a base.

Uracil

In one embodiment, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-amino allyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s2U), 5-propynyl-uridine, 1-propynyl-pseudouridine, 5-taurinomethyl-uridine (τcm$^5$U), 1-taurinomethyl-pseudouridine, 5-taurinomethyl-2-thio-uridine (τm$^5$ s2U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s2U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp$^3$U), 1-methyl-3-(3-amino-3-carboxypropyl)pseudouridine (acp$^3$ψ), 5-(isopentenylaminomethyl)uridine (inm$^5$U), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl- 2'-O-methyl-uridine (cmnm⁵Um), 3,2'-O-dimethyl-uridine (m³Um), 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In one embodiment, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m³C), N4-acetyl-cytidine (act), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k²C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In one embodiment, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenosine (m²A), N6-methyl-adenosine (m⁶A), 2-methylthio-N6-methyl-adenosine (ms2m⁶A), N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenosine, 2-methylthio-adenosine, 2-methoxy-adenosine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In one embodiment, the modified nucleobase is a modified guanine. Exemplary nucleobases and nucleosides having a modified guanine include without limitation inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2, N2,7-dimethyl-guanosine (m²,2,7G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

Exemplary Modified gRNAs

In some embodiments, the modified nucleic acids can be modified gRNAs. It is to be understood that any of the gRNAs described herein can be modified in accordance with this section.

As discussed above and in the Examples, we have found that the guide RNA (gRNA) component of the CRISPR/Cas9 system is more efficient at editing genes in T cells when it has been modified at or near its 5' end (e.g., when the 5' end of a gRNA is modified by the inclusion of a eukaryotic mRNA cap structure or cap analog). While not wishing to be bound by theory it is believed that these and other modified gRNAs described herein elicit a reduced innate immune response from certain circulatory cell types (e.g., T cells) and that this might be responsible for the observed improvements.

The present disclosure encompasses the realization that the improvements observed with a 5' capped gRNA can be extended to gRNAs that have been modified in other ways to achieve the same type of structural or functional result (e.g., by the inclusion of modified nucleosides or nucleotides, or when an in vitro transcribed gRNA is modified by treatment with a phosphatase such as calf intestinal alkaline phosphatase to remove the 5' triphosphate group). While not wishing to be bound by theory, in some embodiments, the modified gRNAs described herein may contain one or more modifications (e.g., modified nucleosides or nucleotides) which introduce stability toward nucleases (e.g., by the inclusion of modified nucleosides or nucleotides and/or a 3' polyA tract).

Thus, in one aspect, methods and compositions discussed herein provide methods and compositions for gene editing by using gRNAs which have been modified at or near their 5' end (e.g., within 1-10, 1-5, or 1-2 nucleotides of their 5' end). In some embodiments, the 5' end of the gRNA molecule lacks a 5' triphosphate group. In some embodiments, the 5' end of the targeting domain lacks a 5' triphosphate group. In some embodiments, the 5' end of the gRNA molecule includes a 5' cap. In some embodiments, the 5' end of the targeting domain includes a 5' cap. In some embodiments, the gRNA molecule lacks a 5' triphosphate group. In some embodiments, the gRNA molecule comprises a targeting domain and the 5' end of the targeting domain lacks a 5' triphosphate group. In some embodiments, gRNA molecule includes a 5' cap. In some embodiments, the gRNA molecule comprises a targeting domain and the 5' end of the targeting domain includes a 5' cap.

In an embodiment, the 5' end of a gRNA is modified by the inclusion of a eukaryotic mRNA cap structure or cap analog (e.g., without limitation, a G(5')ppp(5')G cap analog, a m7G(5')ppp(5')G cap analog, or a 3'-O-Me-m7G(5')ppp(5')G anti reverse cap analog (ARCA)). In certain embodiments the 5' cap comprises a modified guanine nucleotide that is linked to the remainder of the gRNA molecule via a 5'-5' triphosphate linkage. In some embodiments, the 5' cap comprises two optionally modified guanine nucleotides that are linked via a 5'-5' triphosphate linkage. In some embodiments, the 5' end of the gRNA molecule has the chemical formula:

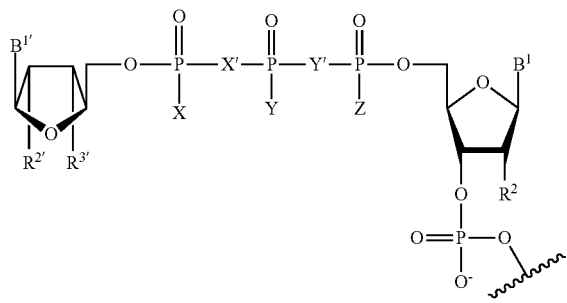

wherein:

each of $B^1$ and $B^{1'}$ is independently

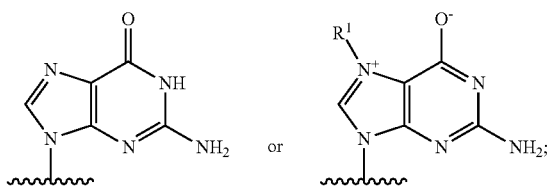

each $R^1$ is independently $C_{1-4}$ alkyl, optionally substituted by a phenyl or a 6-membered heteroaryl;

each of $R^2$, $R^{2'}$, and $R^{3'}$ is independently H, F, OH, or O—$C_{1-4}$ alkyl;

each of X, Y, and Z is independently O or S; and each of X' and Y' is independently O or $CH_2$.

In an embodiment, each $R^1$ is independently —$CH_3$, —$CH_2CH_3$, or —$CH_2C_6H_5$.

In an embodiment, $R^1$ is —$CH_3$.

In an embodiment, $B^{1'}$ is

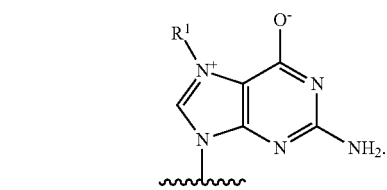

In an embodiment, each of $R^2$, $R^{2'}$, and $R^{3'}$ is independently H, OH, or O—$CH_3$.

In an embodiment, each of X, Y, and Z is O.

In an embodiment, X' and Y' are O.

In an embodiment, the 5' end of the gRNA molecule has the chemical formula:

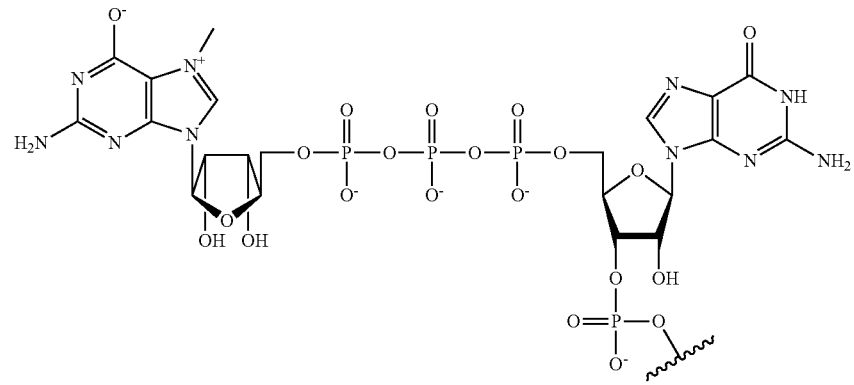

In an embodiment, the 5' end of the gRNA molecule has the chemical formula:

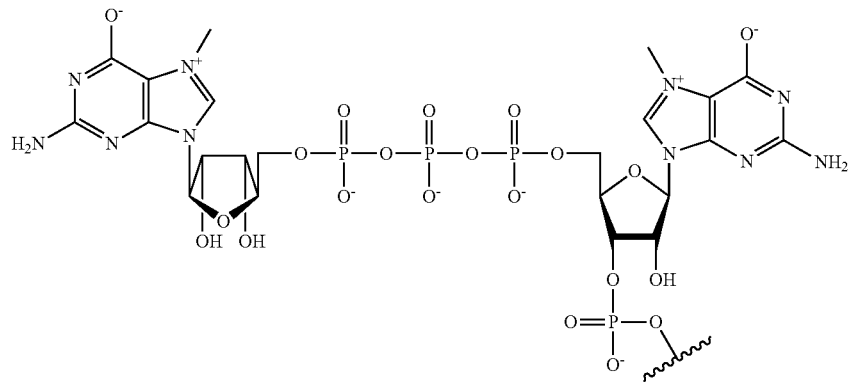

20

In an embodiment, the 5' end of the gRNA molecule has the chemical formula:

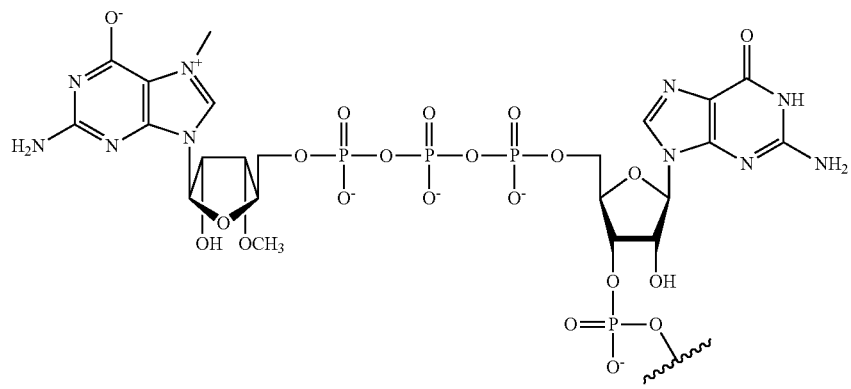

40

In an embodiment, the 5' end of the gRNA molecule has the chemical formula:

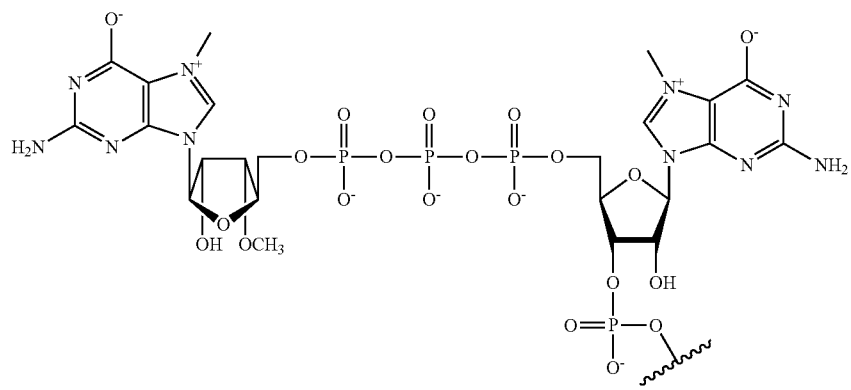

60

In an embodiment, X is S, and Y and Z are O.
In an embodiment, Y is S, and X and Z are O.
In an embodiment, Z is S, and X and Y are O.
In an embodiment, the phosphorothioate is the Sp diastereomer.
In an embodiment, X' is $CH_2$, and Y' is O.

In an embodiment, X' is O, and Y' is $CH_2$.

In an embodiment, the 5' cap comprises two optionally modified guanine nucleotides that are linked via an optionally modified 5'-5' tetraphosphate linkage.

In an embodiment, the 5' end of the gRNA molecule has the chemical formula:

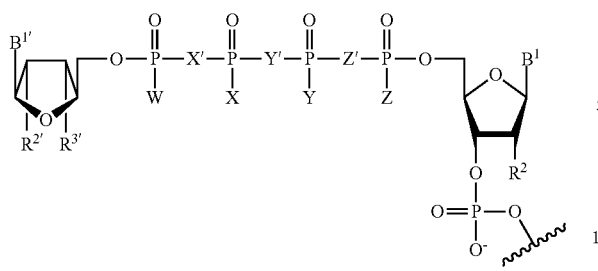

wherein:

each of $B^1$ and $B^{1'}$ is independently

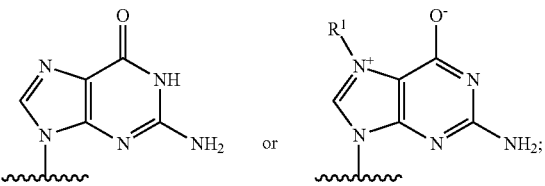

each $R^1$ is independently $C_{1-4}$ alkyl, optionally substituted by a phenyl or a 6-membered heteroaryl;

each of $R^2$, $R^{2'}$, and $R^{3'}$ is independently H, F, OH, or O—$C_{1-4}$ alkyl;

each of W, X, Y, and Z is independently O or S; and each of X', Y', and Z' is independently O or $CH_2$.

In an embodiment, each $R^1$ is independently —$CH_3$, —$CH_2CH_3$, or —$CH_2C_6H_5$.

In an embodiment, $R^1$ is —$CH_3$.

In an embodiment, $B^{1'}$ is

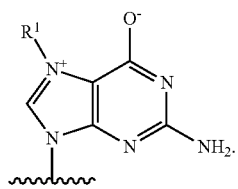

In an embodiment, each of $R^2$, $R^{2'}$, and $R^{3'}$ is independently H, OH, or O—$CH_3$.

In an embodiment, each of W, X, Y, and Z is O.

In an embodiment, each of X', Y', and Z' are O.

In an embodiment, X' is $CH_2$, and Y' and Z' are O.

In an embodiment, Y' is $CH_2$, and X' and Z' are O.

In an embodiment, Z' is $CH_2$, and X' and Y' are O.

In an embodiment, the 5' cap comprises two optionally modified guanine nucleotides that are linked via an optionally modified 5'-5' pentaphosphate linkage.

In an embodiment, the 5' end of the gRNA molecule has the chemical formula:

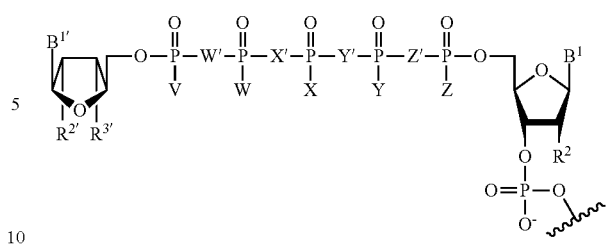

wherein:

each of $B^1$ and $B^{1'}$ is independently

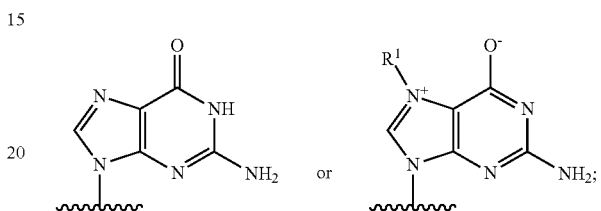

each $R^1$ is independently $C_{1-4}$ alkyl, optionally substituted by a phenyl or a 6-membered heteroaryl;

each of $R^2$, $R^{2'}$, and $R^{3'}$ is independently H, F, OH, or O—$C_{1-4}$ alkyl;

each of V, W, X, Y, and Z is independently O or S; and each of W', X', Y', and Z' is independently O or $CH_2$.

In an embodiment, each $R^1$ is independently —$CH_3$, —$CH_2CH_3$, or —$CH_2C_6H_5$.

In an embodiment, $R^1$ is —$CH_3$.

In an embodiment, $B^{1'}$ is

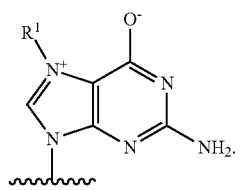

In an embodiment, each of $R^2$, $R^{2'}$, and $R^{3'}$ is independently H, OH, or O—$CH_3$.

In an embodiment, each of V, W, X, Y, and Z is O.

In an embodiment, each of W', X', Y', and Z' is O.

It is to be understood that as used herein, the term "5' cap" encompasses traditional mRNA 5' cap structures but also analogs of these. For example, in addition to the 5' cap structures that are encompassed by the chemical structures shown above, one may use, e.g., tetraphosphate analogs having a methylene-bis(phosphonate) moiety (e.g., see Rydzik, A M et al., (2009) Org Biomol Chem 7(22):4763-76), analogs having a sulfur substitution for a non-bridging oxygen (e.g., see Grudzien-Nogalska, E. et al, (2007) RNA 13(10): 1745-1755), N7-benzylated dinucleoside tetraphosphate analogs (e.g., see Grudzien, E. et al., (2004) RNA 10(9): 1479-1487), or anti-reverse cap analogs (e.g., see U.S. Pat. No. 7,074,596 and Jemielity, J. et al., (2003) RNA 9(9): 1 108-1 122 and Stepinski, J. et al., (2001) RNA 7(10):1486-1495). The present application also encompasses the use of cap analogs with halogen groups instead of OH or OMe (e.g., see U.S. Pat. No. 8,304,529); cap analogs with at least one phosphorothioate (PS) linkage (e.g., see U.S. Pat. No. 8,153,773 and Kowalska, J. et al., (2008) RNA 14(6): 1119-1131); and cap analogs with at least one boranophosphate or phosphoroselenoate linkage (e.g., see U.S. Pat. No. 8,519,110); and alkynyl-derivatized 5' cap analogs (e.g., see U.S. Pat. No. 8,969,545).

In general, the 5' cap or cap analog can be included during either chemical synthesis or in vitro transcription of the gRNA. In an embodiment, a 5' cap is not used and the gRNA (e.g., an in vitro transcribed gRNA) is instead modified by treatment with a phosphatase (e.g., calf intestinal alkaline phosphatase) to remove the 5' triphosphate group.

In one embodiment, the 3' end of a gRNA is modified by the addition of one or more (e.g., 25-200) adenine (A) residues. The polyA tract can be contained in the nucleic acid (e.g., plasmid, PCR product, viral genome) encoding the gRNA, or can be added to the gRNA during chemical synthesis, or following in vitro transcription using a polyadenosine polymerase (e.g., *E. coli* Poly(A)Polymerase).

Methods and compositions discussed herein also provide methods and compositions for gene editing by using agRNA molecule which comprises a polyA tail (also called a polyA tract herein). Such gRNA molecules may, for example, be prepared by adding a polyA tail to a gRNA molecule precursor using a polyadenosine polymerase following in vitro transcription of the gRNA molecule precursor. For example, in one embodiment, a polyA tail of may be added enzymatically using a polymerase such as *E. coli* polyA polymerase (E-PAP). gRNAs including a polyA tail may also be prepared by in vitro transcription from a DNA template. In one embodiment, a polyA tail of defined length (e.g., 1, 5, 10, 20, 30, 40, 50, 60, 100, or 150 nucleotides) is encoded on a DNA template and transcribed with the gRNA via an RNA polymerase (e.g., a T7 RNA polymerase). gRNAs with a polyA tail may also be prepared by ligating a polyA oligonucleotide to a gRNA molecule precursor following in vitro transcription using an RNA ligase or a DNA ligase with or without a splinted DNA oligonucleotide complementary to the gRNA molecule precursor and the polyA oligonucleotide. For example, in one embodiment, a polyA tail of defined length In one embodiment, a polyA tail of defined length (e.g., 1, 5, 10, 20, 30, 40, 50, 60, 100, or 150 nucleotides) is synthesized as a synthetic oligonucleotide and ligated on the 3' end of the gRNA with either an RNA ligase or a DNA ligase with or without a splinted DNA oligonucleotide complementary to the guide RNA and the polyA oligonucleotide. gRNAs including the polyA tail may also be prepared synthetically, in one or several pieces, that are ligated together by either an RNA ligase or a DNA ligase with or without one or more splinted DNA oligonucleotides.

In some embodiments, the polyA tail is comprised of fewer than 50 adenine nucleotides, for example, fewer than 45 adenine nucleotides, fewer than 40 adenine nucleotides, fewer than 35 adenine nucleotides, fewer than 30 adenine nucleotides, fewer than 25 adenine nucleotides or fewer than 20 adenine nucleotides. In some embodiments the polyA tail is comprised of between 5 and 50 adenine nucleotides, for example between 5 and 40 adenine nucleotides, between 5 and 30 adenine nucleotides, between 10 and 50 adenine nucleotides, or between 15 and 25 adenine nucleotides. In some embodiments, the polyA tail is comprised of about 20 adenine nucleotides.

In some embodiments, the polyA tail comprises at least 5, at least 10, at least 20, at least 30, at least 40, at least 50, at least 60, at least 70, at least 80, at least 90, or at least 100 adenine nucleotides. In one embodiment, the polyA tail is comprised of between 5 and 100 adenine nucleotides. In another embodiment, the polyA tail is comprised of between 5 and 90 adenine nucleotides. In another embodiment, the polyA tail is comprised of between 5 and 80 adenine nucleotides. In another embodiment, the polyA tail is comprised of between 5 and 70 adenine nucleotides. In another embodiment, the polyA tail is comprised of between 5 and 60 adenine nucleotides. In another embodiment, the polyA tail is comprised of between 5 and 50 adenine nucleotides. In another embodiment, the polyA tail is comprised of between 5 and 40 adenine nucleotides. In another embodiment, the polyA tail is comprised of between 5 and 30 adenine nucleotides.

In another embodiment, the polyA tail is comprised of between 15 and 90 adenine nucleotides. In another embodiment, the polyA tail is comprised of between 25 and 90 adenine nucleotides. In another embodiment, the polyA tail is comprised of between 35 and 90 adenine nucleotides. In another embodiment, the polyA tail is comprised of between 45 and 90 adenine nucleotides. In another embodiment, the polyA tail is comprised of between 55 and 90 adenine nucleotides. In another embodiment, the polyA tail is comprised of between 65 and 90 adenine nucleotides.

In another embodiment, the polyA tail is comprised of between 5 and 75 adenine nucleotides. In another embodiment, the polyA tail is comprised of between 10 and 50 adenine nucleotides. In another embodiment, the polyA tail is comprised of between 15 and 25 adenine nucleotides.

In another embodiment, the polyA tail is comprised of between 25 and 90 adenine nucleotides. In another embodiment, the polyA tail is comprised of between 30 and 75 adenine nucleotides. In another embodiment, the polyA tail is comprised of between 40 and 60 adenine nucleotides.

In another embodiment, the polyA tail is comprised of between 40 and 95 adenine nucleotides. In another embodiment, the polyA tail is comprised of between 55 and 90 adenine nucleotides. In another embodiment, the polyA tail is comprised of between 60 and 85 adenine nucleotides.

In another aspect, methods and compositions discussed herein provide methods and compositions for gene editing by using gRNAs which include one or more modified nucleosides or nucleotides that are described herein. In some embodiments, the inclusion of the one or more modified nucleosides or nucleotides causes the gRNA to elicit a reduced innate immune response in certain circulating cell types (e.g., T cells, macrophages, dendritic cells, and/or B cells) as compared to an otherwise unmodified gRNA.

While some of the exemplary modifications discussed in this section may be included at any position within the gRNA sequence, in some embodiments, a gRNA comprises a modification at or near its 5' end (e.g., within 1-10, 1-5, or 1-2 nucleotides of its 5' end). In some embodiments, a gRNA comprises a modification at or near its 3' end (e.g., within 1-10, 1-5, or 1-2 nucleotides of its 3' end). In some embodiments, a gRNA comprises both a modification at or near its 5' end and a modification at or near its 3' end. For example, in some embodiments, a gRNA molecule (e.g., an in vitro transcribed gRNA) comprises a targeting domain which is complementary with a target domain from a gene expressed in a eukaryotic cell, wherein the gRNA molecule is modified at its 5' end and comprises a 3' polyA tail. The gRNA molecule may, for example, lack a 5' triphosphate group (e.g., the 5' end of the targeting domain lacks a 5' triphosphate group). In an embodiment, a gRNA (e.g., an in vitro transcribed gRNA) is modified by treatment with a phosphatase (e.g., calf intestinal alkaline phosphatase) to remove the 5' triphosphate group and comprises a 3' polyA tail as described herein. The gRNA molecule may alternatively include a 5' cap (e.g., the 5' end of the targeting domain includes a 5' cap). In an embodiment, a gRNA (e.g., an in vitro transcribed gRNA) contains both a 5' cap structure or cap analog and a 3' polyA tail as described herein. In some embodiments, the 5' cap comprises a modified guanine nucleotide that is linked to the remainder of the gRNA molecule via a 5'-5' triphosphate linkage. In some embodiments, the 5' cap comprises two optionally modified guanine nucleotides that are linked via an optionally modified 5'-5' triphosphate linkage (e.g., as described above). In some embodiments the polyA tail is comprised of between 5 and 50 adenine nucleotides, for example between 5 and 40 adenine nucleotides, between 5 and 30 adenine nucleotides, between 10 and 50 adenine nucleotides, between 15 and 25 adenine nucleotides, fewer than 30 adenine nucleotides, fewer than 25 adenine nucleotides or about 20 adenine nucleotides.

In yet other embodiments, the present disclosure provides a gRNA molecule comprising a targeting domain which is complementary with a target domain from a gene expressed in a eukaryotic cell, wherein the gRNA molecule comprises a 3' polyA tail which is comprised of fewer than 30 adenine nucleotides (e.g., fewer than 25 adenine nucleotides, between 15 and 25 adenine nucleotides, or about 20 adenine nucleotides). In some embodiments, these gRNA molecules are further modified at their 5' end (e.g., the gRNA molecule is modified by treatment with a phosphatase to remove the 5' triphosphate group or modified to include a 5' cap as described herein).

In some embodiments, gRNAs can be modified at a 3' terminal U ribose. In some embodiments, the 5' end and a 3' terminal U ribose of the gRNA are modified (e.g., the gRNA is modified by treatment with a phosphatase to remove the 5' triphosphate group or modified to include a 5' cap as described herein). For example, the two terminal hydroxyl groups of the U ribose can be oxidized to aldehyde groups and a concomitant opening of the ribose ring to afford a modified nucleoside as shown below:

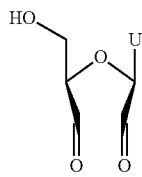

wherein "U" can be an unmodified or modified uridine.

In another embodiment, the 3' terminal U can be modified with a 2'3' cyclic phosphate as shown below:

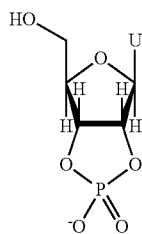

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines, cytidines and guanosines can be replaced with modified adenosines, cytidines and guanosines, e.g., with modifications at the 8-position, e.g., 8-bromo guanosine, or with any of the modified adenosines, cytidines or guanosines described herein.

In some embodiments, sugar-modified ribonucleotides can be incorporated into the gRNA molecule, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclylamino, arylamino, diarylamino, heteroarylamino, diheteroarylamino, or amino acid); or cyano (—CN). In some embodiments, the phosphate backbone can be modified as described herein, e.g., with a phosphothioate group. In some embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclylamino, arylamino, diarylamino, heteroarylamino, or diheteroarylamino, ethylenediamine, or polyamino) and aminoalkoxy or $O(CH_2)_n$-amino (wherein amino can be, e.g., $NH_2$; alkylamino, dialkylamino, heterocyclylamino, arylamino, diarylamino, heteroarylamino, or diheteroarylamino, ethylenediamine, or polyamino).

In some embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-(3'→2')).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In an embodiment, a gRNA comprises a 4'-S, 4'-Se or a 4'-C-aminomethyl-2'-O-Me modification.

In some embodiments, deaza nucleotides, e.g., 7-deazaadenosine, can be incorporated into the gRNA molecule. In some embodiments, O- and N-alkylated nucleotides, e.g., N6-methyl adenosine, can be incorporated into the gRNA molecule. In some embodiments, one or more or all of the nucleotides in a gRNA molecule are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory it is believed that this down regulation occurs either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative and are not intended to limit the scope or content of the disclosure provided herein in any way.

Example 1: Cloning and Initial Screening of gRNAs

The suitability of candidate gRNAs can be evaluated as described in this example. Although described for a chimeric gRNA, the approach can also be used to evaluate modular gRNAs.

Cloning gRNAs into Vectors

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters maybe used to drive in vivo transcription (e.g., H1 promoter) or for in vitro transcription (e.g., a T7 promoter).

Cloning gRNAs in Linear dsDNA Molecule (STITCHR)

For each gRNA, a single oligonucleotide is designed and obtained. The U6 promoter and the gRNA scaffold (e.g., including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562, or U2OS. Alternatively, primary human cells may be used. In this case, cells may be relevant to the eventual therapeutic cell target (for example, an erythroid cell). The use of primary cells similar to the potential therapeutic stem cell population may provide important information on gene targeting rates in the context of endogenous chromatin and gene expression.

Transfection may be performed using lipid transfection (such as Lipofectamine or Fugene) or by electroporation (such as Lonza Nucleofection™). Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) that recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, mini-prepped and sequenced with a single primer. Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Assessment of Gene Targeting by NHEJ

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of alleles have undergone NHEJ-induced indels that result in a frameshift or large deletion or insertion that would be expected to destroy gene function. If the goal is to remove a specific sequence motif, sequencing may be used to assess what percent of alleles have undergone NHEJ-induced deletions that span this sequence.

Example 3: Assessment of Gene Targeting by HDR

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency can be determined by several methods.

Determination of gene targeting frequency involves measuring the percentage of alleles that have undergone homologous directed repair (HDR) with the exogenously provided donor template or endogenous genomic donor sequence and which therefore have incorporated the desired correction. If the desired HDR event creates or destroys a restriction enzyme site, the frequency of gene targeting may be determined by a RFLP assay. If no restriction site is created or destroyed, sequencing may be used to determine gene targeting frequency. If a RFLP assay is used, sequencing may still be used to verify the desired HDR event and ensure that no other mutations are present. If an exogenously provided donor template is employed, at least one of the primers is placed in the endogenous gene sequence outside of the region included in the homology arms, which prevents amplification of donor template still present in the cells. Therefore, the length of the homology arms present in the donor template may affect the length of the PCR amplicon. PCR amplicons can either span the entire donor region (both primers placed outside the homology arms) or they can span only part of the donor region and a single junction between donor and endogenous DNA (one internal and one external primer). If the amplicons span less than the entire donor region, two different PCRs should be used to amplify and sequence both the 5' and the 3' junction.

If the PCR amplicon is short (less than 600 bp) it is possible to use next generation sequencing. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low gene targeting rates.

If the PCR amplicon is too long for next generation sequencing, Sanger sequencing can be performed. For Sanger sequencing, purified PCR amplicons will be cloned into a plasmid backbone (for example, TOPO cloned using the LifeTech Zero Blunt® TOPO® cloning kit), transformed, miniprepped and sequenced.

The same or similar assays described above can be used to measure the percentage of alleles that have undergone HDR with endogenous genomic donor sequence and which therefore have incorporated the desired correction.

Example 4: Testing S. Aureus Cas9 gRNAs Targeted to the CCR5 Locus

Transplantation of autologous CD34$^+$ hematopoietic stem/progenitor cells (HSCs) that have been genetically modified to prevent expression of the wild-type CCR5 gene product prevents entry of the HIV virus HSC progeny that are normally susceptible to HIV infection (e.g., macrophages and CD4 T-lymphocytes). Clinically, transplantation of HSCs that contain a genetic mutation in the coding sequence for the CCR5 chemokine receptor has been shown to control HIV infection long-term (Hütter et al., *New England Journal Of Medicine,* 2009; 360(7):692-698). Genome editing with the CRISPR/Cas9 platform precisely alters endogenous gene targets, e.g., by creating an indel at the targeted cut site that can lead to inhibition of gene expression at the edited locus. In this Example, genome editing with eleven *S. aureus* Cas9 gRNAs that were selected (Table 10) based on the criterion described in Section II (Methods for Designing gRNAs).

Figure 1:
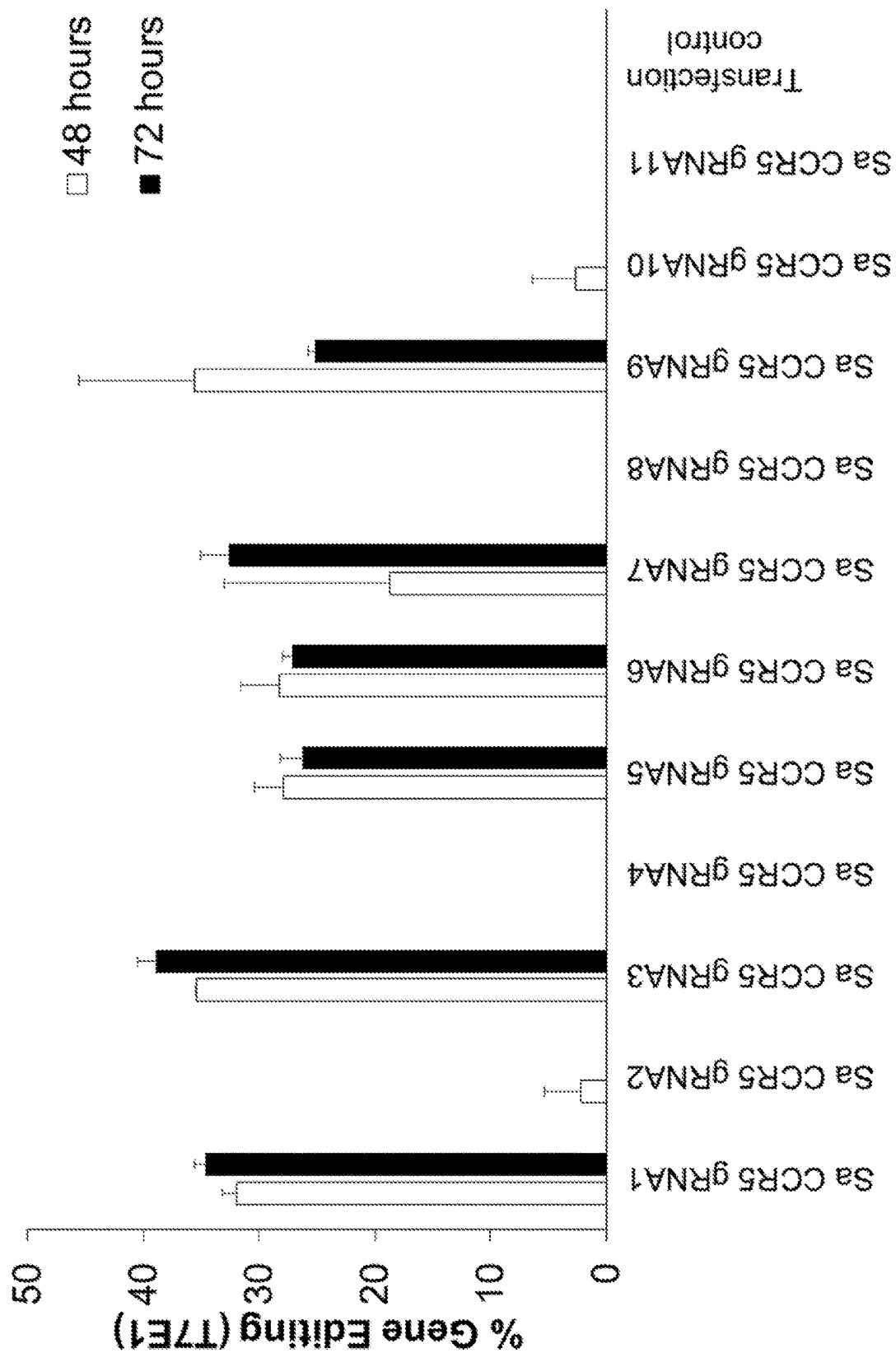
FIG. 1 depicts the detection of indels at the CCR5 locus after delivery of S. aureus gRNA and S. aureus Cas9.

Human 293FT cells (Life Technologies) were transfected (Lipofectamine™, per the manufacturer's instructions) with plasmid DNA encoding *S. aureus* Cas9 and oligonucleotides encoding different *S. aureus* gRNAs that are transcribed in the stem cells from the U6 promoter. Genomic DNA was isolated at 48 and 72 hour time points relative to transfection, CCR5 locus PCRs performed on gDNA, and the indels were analysis by T7E1 endonuclease assay. Values shown are the mean+/−s.d. of 2 technical replicates (FIG. 1). In order to detect indels at the CCR5 locus, T7E1 assays were performed on CCR5 locus-specific PCR products that were amplified from genomic DNA samples from transfected and then percentage of indels detected at the CCR5 locus was calculated. Up to 40% indels were detected in cells that contacted the *S. aureus* CCR5 gRNAs and *S. aureus* Cas9 plasmid DNA.

TABLE 10

S. aureus Cas9 gRNA target sequences

| S. aureus gRNA Name Designation | S. aureus gRNA Target Sequence | SEQ ID NO |
|---|---|---|
| CCR5_Sa1 | GCC UAU AAA AUA GAG CCC UGU C | 495 |
| CCR5_Sa2 | AUA CAG UCA GUA UCA AUU CUG G | 496 |
| CCR5_Sa3 | GUG GUG ACA AGU GUG AUC AC | 497 |
| CCR5_Sa4 | CCA UAC AGU CAG UAU CAA UUC UGG | 498 |
| CCR5_Sa5 | AAG CCU AUA AAA UAG AGC CCU GUC | 499 |
| CCR5_Sa6 | UGG GGU GGU GAC AAG UGU GAU CAC | 500 |
| CCR5_Sa7 | GGG UGG UGA CAA GUG UGA UCA C | 501 |
| CCR5_Sa8 | GGU GAC AAG UGU GAU CAC | 502 |
| CCR5_Sa9 | GCC UUU UGC AGU UUA UCA GGA U | 503 |
| CCR5_Sa10 | GCU CUA UUU UAU AGG CUU CUU CUC | 504 |
| CCR5_Sa11 | GCU CUU CAG CCU UUU GCA GUU UAU | 505 |

Example 5: Contact Between Cytokines and Small Molecule Cell Viability Enhancer UM171 with Human Mobilized Peripheral Blood CD34+ HSCs Improved Cell Viability, Survival, and Genome Editing at the CCR5 Genomic Locus In this Example, genome editing in human mobilized peripheral blood CD34+ HSCs after co-delivery of Cas9 with gRNA targeting the CCR5 locus was evaluated to induce gene editing in CD34+ cells.

Human CD34+ HSCs cells from mobilized peripheral blood (AllCells) were thawed into StemSpan Serum-Free Expansion Medium (SFEM™, StemCell Technologies) containing 100 ng/mL each of the following cytokines: human stem cell factor (SCF), thrombopoietin (TPO), and flt-3 ligand (FL) (all from Peprotech). Cells were grown for 3 days in a humidified incubator and 5% $CO_2$ 20% $O_2$. On day 3, media was replaced with fresh Stemspan-SFEM™ supplemented with human 100 ng/mL human SCF, TPO, FL and 40 nM of the small molecule cell viability enhancer UM171 (Xcess Bio), a human HSC self-renewal agonist (Fares et. al, Science, 2014; 345(6203):1509-1512). The published use of UM171 involved prolonged exposure (12 days) of cord blood HSCs to the small molecule for ex vivo expansion. In the current experiment, HSCs were exposed to UM171 for 2 hours before and 24 hours after delivery of Cas9 and gRNA plasmid DNA. This UM171 treatment protocol was based on the pilot studies that indicated acute pre-treatment with UM171 before lentivirus vector mediated gene delivery improved HSC viability compared to HSCs treated with vehicle (dimethylsulfoxide, DMSO, Sigma) alone. After the 2-hour pretreatment with 40 nM UM171, 1 million CD34+ HSCs were Nucleofected™ with the Amaxa™ 4D Nucleofector™ device (Lonza), Program EO100 using components of the P3 Primary Cell 4D-Nucleofector Kit™ (Lonza) according to the manufacturer's instructions. Briefly, one million cells were suspended in Nucleofector™ solution and the following amounts of plasmid DNA were added to the cell suspension: 1250 ng plasmid expressing CCR5 gRNA (CCR5-U43) from the human U6 promoter and 3750 ng plasmid expressing wild-type S. pyogenes Cas 9 transcriptionally regulated by the CMV promoter. After Nucleofection™, cells were plated into Stemspan-SFEM™ supplemented with SCF, TPO, FL and 40 nM UM171. After overnight incubation, HSCs were plated in Stemspan-SFEM™ plus cytokines without UM171. At 96 hours after Nucleofection™, CD34+ cells were counted for by trypan blue exclusion and divided into 3 portions for the following analyses: a) flow cytometry analysis for assessment of viability by co-staining with 7-Aminoactinomycin-D (7-AAD) and allophycocyanin (APC)-conjugated Annexin-V antibody (ebioscience); b) flow cytometry analysis for maintenance of HSC phenotype (after co-staining with phycoerythrin (PE)-conjugated anti-human CD34 antibody and fluorescein isothicyanate (FITC)-conjugated anti-human CD90, both from BD Bioscience; c) hematopoietic colony forming cell (CFC) analysis by plating 1500 cells in semi-solid methylcellulose based Methocult medium (StemCell Technologies) that supports differentiation of erythroid and myeloid blood cell colonies from HSCs and serves as a surrogate assay to evaluate HSC multipotency and differentiation potential ex vivo; d) genomic DNA analysis for detection of editing at the CCR5 locus. Genomic DNA was extracted from HSCs 96 hours after Nucleofection™, and CCR5 locus-specific PCR reactions were performed.

Figure 2:
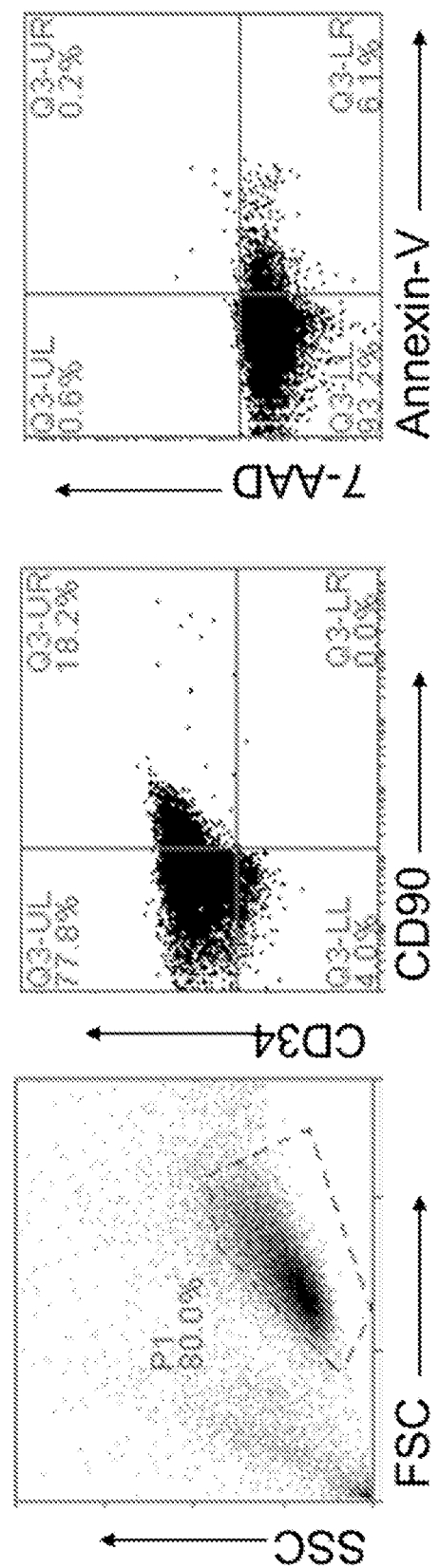
FIG. 2 depicts the flow cytometry analysis of genome edited HSCs to determine co-expression of stem cell phenotypic markers CD34 and CD90 and for viability (7-AAD$^-$ AnnexinV$^-$ cells).

As shown in FIG. 2, contact of small molecule cell viability enhancer UM171 and CD34+ HSCs maintained stem cell phenotype and viability after Nucleofection™ with Cas9 and CCR5 gRNA plasmid DNA (96 hours).

HSCs that were Nucleofected™ with Cas9 and CCR5 gRNA plasmids after pre-treatment with UM171, human SCF, TPO, and FL exhibited >93% viability (7-AAD− Annexin V−) and maintained co-expression of CD34 and CD90, as determined by flow cytometry analysis (FIG. 2). In addition, the UM171-treated Nucleofected™ cells were able to divide, as there was a change in CD34+ HSC in cell number with a fold-change in the number of cells similar to the level achieved with unelectroporated HSCs (Table 11). In contrast, HSCs Nucleofected™ without UM171 pre-treatment had decreased viability and there was a negative fold change in live CD34+ HSC cell number.

TABLE 11

Short-term treatment UM171 preserves CD34+ HSC viability after Nucleofection ™ with wild type Cas9 and CCR5-U43 gRNA plasmid DNA (96 hours)

| Condition | Fold-change in the number of live CD34+ HSCs (96 hours) |
|---|---|
| No Nucleofection ™ | 1.6 |
| Nucleofection ™ + UM171 treatment | 1.5 |
| Nucleofection ™ + vehicle treatment | 0.6 |

In order to detect indels at the CCR5 locus, T7E1 assays were performed on CCR5 locus-specific PCR products that were amplified from genomic DNA samples from Nucleofected™ CD34+ HSCs and then percentage of indels detected at the CCR5 locus was calculated. Twenty percent indels was detected in the genomic DNA from CD34+ HSCs Nucleofected™ with Cas9 and CCR5 gRNA plasmids after pre-treatment with UM171.

To evaluate maintenance of HSC potency and differentiation potential, two weeks after plating CD34+ HSCs in CFC assays, hematopoietic activity was quantified based on scoring the HSC progeny by enumerating the total number of hematopoietic colony forming units (CFU) and the frequencies of specific blood cell phenotypes, including: mixed myeloid/erythroid (Granulocyte-erythroid-monocyte macrophage, CFU-GEMM), myeloid (CFU-macrophage (M), granulocyte-macrophage (CFU-GM)) and erythroid (CFU-E) colonies. CD34+ HSCs that were Nucleofected™ after UM171 pre-treatment maintained CFC potential compared to un-Nucleofected™ HSCs (Table 12). In contrast, CD34+ HSCs that were Nucleofected™ without UM171 pre-treatment had reduced CFC potential (lower total CFC counts and reduced numbers of mixed-phenotype colonies (CFU-GEMM) and erythroid colonies (CFU-E)) in comparison to un-Nucleofected™ CD34+ HSCs.

TABLE 12

UM171 preserves CD34+ HSC viability and multipotency after Nucleofection ™ with wild-type Cas9 and CCR5-U43 gRNA plasmid DNA (two weeks)

| | Number of colony forming units per 1500 CD34+ HSCs plated | | | | | |
|---|---|---|---|---|---|---|
| Condition | E | G | M | GM | GEMM | Total |
| No Nucleofection ™ | 64 | 3 | 88 | 5 | 11 | 171 |
| Nucleofection ™ + UM171 | 92 | 40 | 64 | 32 | 20 | 228 |
| Nucleofection ™ + vehicle | 18 | 22 | 6 | 1 | 1 | 28 |

Delivery of co-delivery wild-type S. pyogenes Cas9 and a single CCR5 gRNA plasmid DNA supported 20% genome editing of CD34+ HSCs, without loss of cell viability, multipotency, self-renewal and differentiation potential. Pretreatment and short-term (24-hour) co-culture with the HSC self-renewal agonist UM171 was critical for maintenance of HSC survival and proliferation after Nucleofection™ with Cas9/gRNA DNA. Clinically, transplantation of HSCs that contain a genetic mutation in the CCR5 gene generated by CRISPR/Cas9 related methods can be used to achieve long term control of HIV infection.

Example 6: Contact Between Cytokines and Small Molecule Cell Viability Enhancer UM171 with Human Mobilized Peripheral Blood CD34+ Stem Cells Improved Cell Viability, Survival, and Genome Editing at the CXCR4 Genomic Locus In this Example, genome editing in human mobilized peripheral blood CD34+ HSCs after co-delivery of Cas9 with gRNA targeting the CXCR4 locus was evaluated to induce gene editing in CD34+ cells after short-term contact with the small molecule cell viability enhancer UM171 and human cytokines. S. pyogenes and S. aureus Cas9 variants paired with CXCR4 gRNAs were used in this example.

Human CD34+ HSCs cells from mobilized peripheral blood (AllCells) were thawed into StemSpan Serum-Free Expansion Medium (SFEM, StemCell Technologies) containing 100 ng/mL each of the following cytokines: human stem cell factor (SCF), thrombopoietin (TPO), and flt-3 ligand (FL) (all from Peprotech). Cells were grown for 3 days in a humidified incubator and 5% $CO_2$ 20% $O_2$. On day 3, media was replaced with fresh Stemspan-SFEM supplemented with human SCF, TPO, FL±40 nM of the small molecule UM171 (Xcess Bio). In the current experiment, HSCs were exposed to UM171 for 2 hours before and 24 hours after delivery of Cas9 and gRNA plasmid DNA. After the 2-hour pretreatment with UM171, $2\times10^5$ CD34+ HSCs were Nucleofected™ with the Amaxa™ 4D Nucleofector™ device (Lonza), using components of the P3 Primary Cell 4D-Nucleofector Kit™ (Lonza) according to the manufacturer's instructions. Briefly, $2\times10^5$ CD34+ cells were suspended in Nucleofector™ solution and the following amounts of plasmid DNA were added to the cell suspension: 250 ng plasmid expressing S. pyogenes CXCR4 gRNA (CXCR4-231; targeting domain sequence: GCGCUUCUG-GUGGCCCU; SEQ ID NO: 491) or S. aureus CXCR4 gRNA (CXCR4-836; targeting domain sequence: GCUC-CAAGGAAAGCAUAGAGGA; SEQ ID NO: 492) from the human U6 promoter each paired with 750 ng plasmid expressing either wild-type S. pyogenes Cas9 or S. aureus Cas9, each regulated by the CMV promoter. After Nucleofection™, cells were plated into Stemspan-SFEM™ supplemented with SCF, TPO, FL with or without 40 nM UM171. After overnight incubation, HSCs were plated in Stemspan-SFEM™ plus cytokines without UM171. At 96 hours after Nucleofection™, CD34+ cells were counted for by trypan blue exclusion and divided into 3 portions for the following analyses: a) flow cytometry analysis for assessment of viability by co-staining with 7-Aminoactinomycin-D (7-AAD) and allophycocyanin (APC)-conjugated Annexin-V antibody (ebioscience); b) flow cytometry analysis for maintenance of HSC phenotype (after co-staining with phycoerythrin (PE)-conjugated anti-human CD34 antibody and fluorescein isothicyanate (FITC)-conjugated anti-human CD90, both from BD Bioscience; c) hematopoietic colony forming cell (CFC) analysis by plating 1,500 cells in semi-solid methylcellulose based Methocult medium (Stem-Cell Technologies) that supports differentiation of erythroid and myeloid blood cell colonies from HSCs and serves as a surrogate assay to evaluate HSC multipotency and differentiation potential ex vivo; d) genomic DNA analysis for detection of editing at the CXCR4 locus. Genomic DNA was extracted from HSCs 96 hours after Nucleofection™, and CXCR4 locus-specific PCR reactions were performed.

Figure 13A:
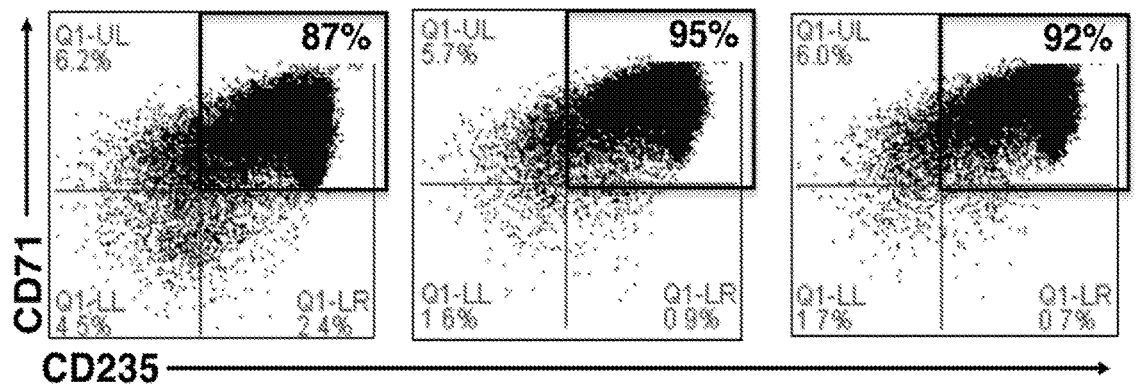
FIGS. 13A, 13B, and 13C depict directed differentiation of gene-edited human CB CD34+ HSCs into erythroblasts. Flow cytometry analysis of day 18 erythroblasts differentiated from gene edited human CB CD34+ HSCs.
Figure 13B:
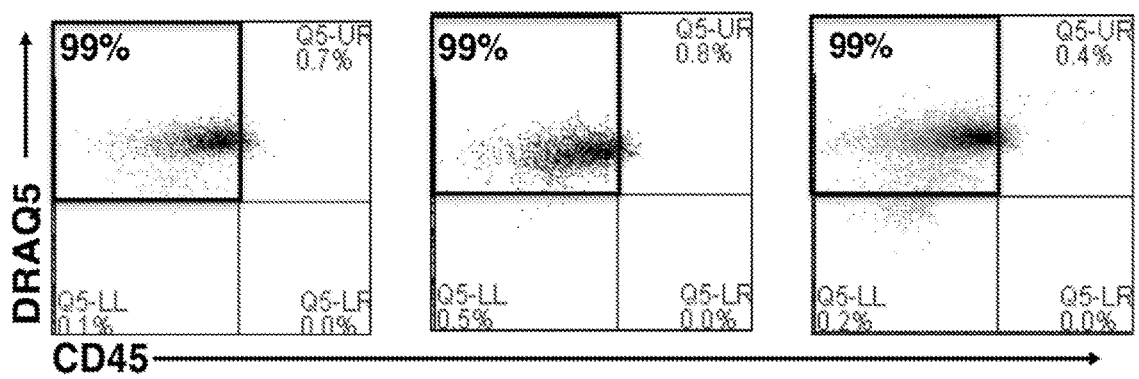

As shown in FIGS. 13A and 13B, UM171 pre-treated CD34+ HSC cell numbers were maintained and exhibited increased genome editing at the CXCR4 locus after Nucleofection™ with plasmids expressing S. aureus (Sa) or S. pyogenes (Spy) Cas9 paired with gRNAs CXCR4-836 (SEQ ID NO: 492) and CXCR4-231 (SEQ ID NO: 491) gRNAs, respectively.

Figure 3A:
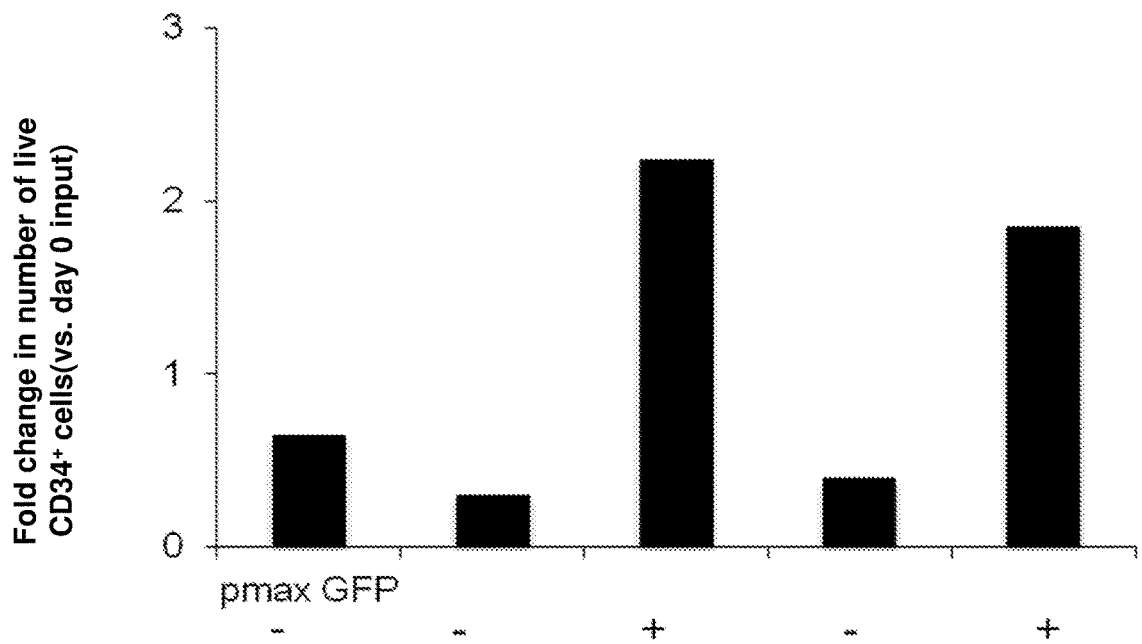
FIG. 3A depicts the fold-change in the number (e.g., maintenance of survival) of Nucleofected™ CD34$^+$ cells 96 hours after delivery of the indicated Cas9 variant paired with CXCR4 gRNA or GFP-expressing plasmid alone (pmax GFP). Treatment +/−40 nM UM171 is indicated by minus sign (−, no UM171) or plus sign (+, with 40 nM UM171).

HSCs that were Nucleofected™ with Cas9 and CXCR4 gRNA (CXCR4-231; SEQ ID NO: 491) plasmids after pre-treatment with UM171 exhibited >95% viability (7-AAD⁻ AnnexinV⁻) and maintained co-expression of CD34 and CD90, as determined by flow cytometry analysis. In addition, the UM171-treated Nucleofected™ cells were maintained, as there was a fold-change (increase) in CD34+ HSC in cell number with a fold-change in the number of cells similar to the level achieved in unelectroporated HSCs (FIG. 3A). In contrast, HSCs Nucleofected™ without UM171 pre-treatment had decreased viability and there was a negative fold-change (decrease) in cell number.

Figure 3B:
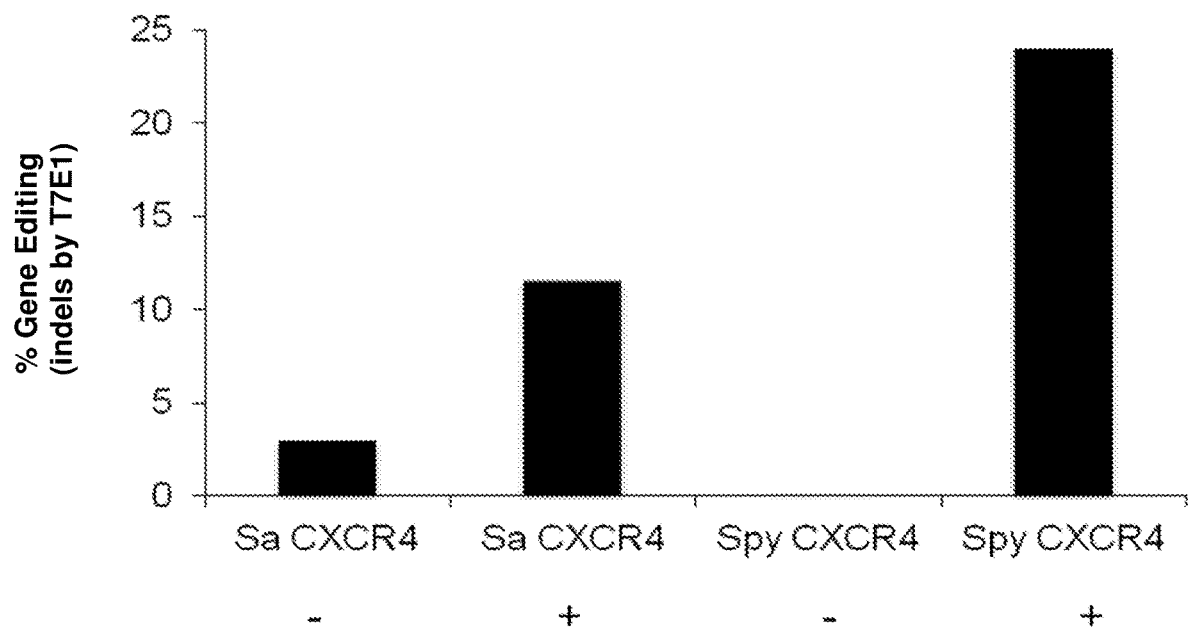
FIG. 3B depicts the percentage of indels as detected by T7E1 assays in CD34$^+$ HSC after the indicated Nucleofections™. Treatment ±40 nM UM171 is indicated by minus sign (−, no UM171) or plus sign (+, with 40 nM UM171).

In order to detect indels at the CXCR4 locus, T7E1 assays were performed on CXCR4 locus-specific PCR products that were amplified from genomic DNA samples from Nucleofected™ CD34+ HSCs and then calculated the percentage of NHEJ detected at the CXCR4 locus. HSCs pre-treated with UM171 exhibited a higher fold-change in the number of cells and higher percentage of genome editing at the CXCR4 locus after delivery of S. aureus or S. pyogenes Cas9 and CXCR4 gRNAs compared to HSCs that were not pre-treated with UM171 (FIG. 3B).

To evaluate maintenance of HSC potency and differentiation potential, two weeks after plating CD34+ HSCs in CFC assays, hematopoietic activity was quantified based on scoring the HSC progeny by enumerating the total number of hematopoietic colony forming units (CFU) and the frequencies of specific blood cell phenotypes, including: mixed myeloid/erythroid (Granulocyte-erythroid-monocyte macrophage, CFU-GEMM), myeloid (CFU-macrophage (M), granulocyte-macrophage (CFU-GM)) and erythroid (CFU-E) colonies. CD34+ HSCs that were pre-treated with UM171 and Nucleofected™ with either S. aureus Cas9 and CXCR4-836 gRNA or S. pyogenes Cas9 and CXCR4-231 gRNA maintained CFC potential compared to un-Nucleofected™ HSCs (Table 13). In contrast, CD34+ HSCs that were Nucleofected™ with either Cas9 variant paired with CXCR4 gRNA without UM171 pre-treatment had reduced CFC potential (lower total CFC counts and reduced numbers of mixed-phenotype colonies (CFU-GEMM) and erythroid colonies (CFU-E) in comparison to un-Nucleofected™ CD34+ HSCs.

TABLE 13

UM171 preserves CD34+ HSC viability after Nucleofection™
S. aureus (Sa) Cas9 and S. pyogenes (Spy) Cas9
paired with CXCR4 gRNA plasmid DNA (two weeks).

| Condition | Number of colony forming units per 1500 CD34+ HSCs plated | | | | | |
|---|---|---|---|---|---|---|
| | E | G | M | GM | GEMM | Total |
| No Nucleofection™ | 64 | 3 | 88 | 5 | 11 | 171 |
| Sa Cas9 + CXCR4-836 gRNA Nucleofection™ + UM171 | 67 | 45 | 29 | 19 | 19 | 212 |
| Spy Cas9 + CXCR4-231 gRNA Nucleofaction™ + UM171 | 60 | 29 | 61 | 27 | 13 | 173 |
| Sa Cas9 + CXCR4-836 gRNA Nucleofection™ + vehicle | 13 | 1 | 6 | 1 | 0 | 2 |
| Spy Cas9 + CXCR4-231 gRNA Nucleofection™ + vehicle | 12 | 2 | 4 | 2 | 2 | 1 |

Co-delivery wild-type S. pyogenes Cas9 and CXCR4-231 gRNA plasmid DNA or S. aureus Cas9 and CXCR4-836 gRNA after contact with the small molecule cell viability enhancer UM171 supported up to 25% genome editing of CD34+ HSCs, without loss of cell viability, multipotency, self-renewal, or differentiation potential. Pre-treatment and short-term (24-hour) co-culture with the HSC self-renewal agonist UM171 was critical for maintenance of HSC survival and proliferation after Nucleofection™ with Cas9/gRNA DNA. Clinically, transplantation of HSCs that contain a genetic mutation in the CXCR4 gene generated by CRISPR/Cas9 related methods can be used to achieve long-term control of HIV infection.

Example 7: Contact Between Cytokines and Small Molecule Cell Viability Enhancer UM171 with Human Mobilized Peripheral Blood CD34+ Stem Cells Improved Cell Viability, Survival, and Genome Editing at the CXCR4 and CCR5 Genomic Loci after Multiplexing of gRNAs Transplantation of autologous CD34+ hematopoietic stem cells (HSCs, also known as hematopoietic stem/progenitor cells or HSCs) that have been genetically modified to prevent expression of the wild-type CXCR4 or the CCR5 gene product prevents entry of the HIV virus HSC progeny that are normally susceptible to HIV infection (e.g., macrophages and CD4 T-lymphocytes). Multiplex genome editing with the CRISPR/Cas9 platform precisely alters more than one endogenous gene targets by creating indels at two different cut sites can lead to knock down of gene expression at multiple edited loci. In this Example, multiplex genome editing in human mobilized peripheral blood CD34+ HSCs after co-delivery of wild-type S. pyogenes Cas9 with one gRNA targeting the CXCR4 locus and one gRNA targeting the CCR5 locus was evaluated to induce multiplex gene editing in CD34+ cells.

Human CD34+ HSCs cells from mobilized peripheral blood (AllCells) were thawed into StemSpan Serum-Free Expansion Medium (SFEM™, StemCell Technologies) containing 100 ng/mL each of the following cytokines: human stem cell factor (SCF), thrombopoietin (TPO), and flt-3 ligand (FL) (all from Peprotech). Cells were grown for 3 days in a humidified incubator and 5% $CO_2$ 20% $O_2$. On day 3, media was replaced with fresh Stemspan-SFEM™ supplemented with human SCF, TPO, FL and 40 nM of the small molecule UM171(Xcess Bio). In the current experiment, HSCs were exposed to UM171 for 2 hours before and 24 hours after delivery of Cas9 and gRNA plasmid DNA. After the 2-hour pretreatment with UM171, $2×10^5$ CD34+ HSCs were Nucleofected™ with the Amaxa™ 4D Nucleofector™ device (Lonza), using components of the P3 Primary Cell 4D-Nucleofector Kit™ (Lonza) according to the manufacturer's instructions. Briefly, $2×10^5$ CD34+ cells were resuspended in Nucleofector™ solution and the following amounts of plasmid DNA were added to the cell suspension: 250 ng plasmid expressing S. pyogenes CXCR4 gRNA (CXCR4-231; SEQ ID NO: 491) from the human U6 promoter, 250 ng plasmid expressing S. pyogenes CCR5 gRNA (CCR5-U43; SEQ ID NO: 493) from the human U6 promoter and 750 ng plasmid expressing wild-type S. pyogenes Cas9 regulated by the CMV promoter. After Nucleofection™, cells were replated into Stemspan-SFEM supplemented with SCF, TPO, FL and UM171. After overnight incubation, HSCs were replated in Stemspan-SFEM™ plus cytokines alone without UM171. At 96 hours after Nucleofection™, CD34+ cells were counted by trypan blue exclusion and divided into 3 portions for the following analyses: a) flow cytometry analysis for assessment of viability by co-staining with 7-Aminoactinomycin-D (7-AAD) and allophycocyanin (APC)-conjugated Annexin-V antibody (ebioscience); b) flow cytometry analysis for maintenance of HSC phenotype (after co-staining with phycoerythrin (PE)-conjugated anti-human CD34 antibody and fluorescein isothicyanate (FITC)-conjugated anti-human CD90, both from BD Bioscience; c) hematopoietic colony forming cell (CFC) analysis by plating 1500 cells in semi-solid methylcellulose based Methocult™ medium (StemCell Technologies) that supports differentiation of erythroid and myeloid blood cell colonies from HSCs and serves as a surrogate assay to evaluate HSC multipotency and differentiation potential ex vivo; d) genomic DNA analysis for detection of editing at the CXCR4 and CCR5 loci. Genomic DNA was extracted from HSCs 96 hours after Nucleofection™, and CXCR4 and CCR5 locus-specific PCR reactions were performed.

Figure 4A:
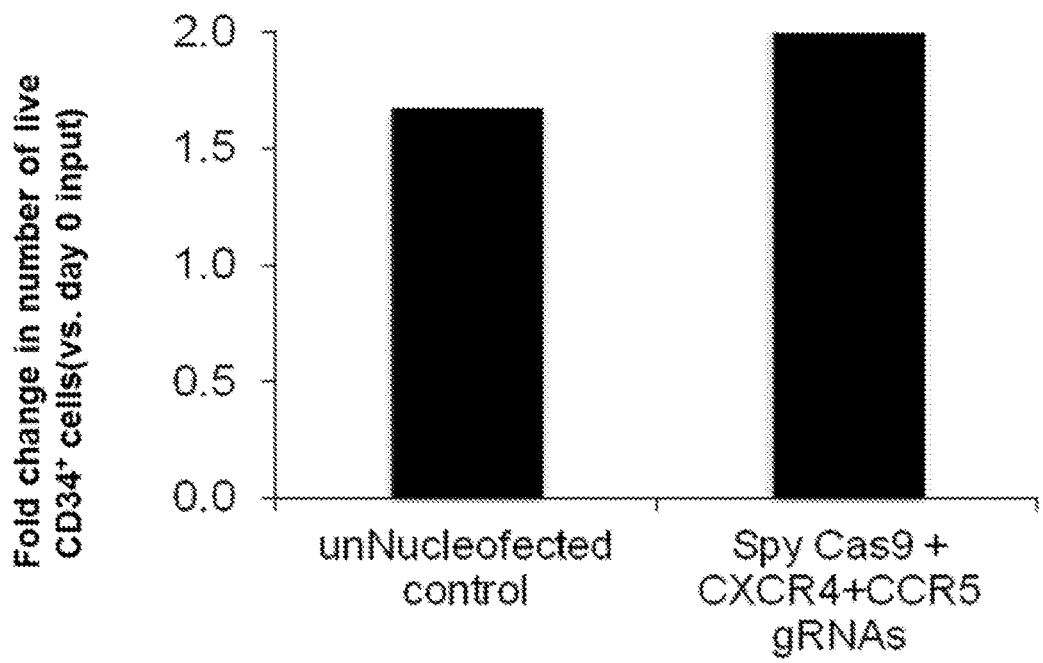
FIG. 4A depicts the fold-change in the number (e.g., maintenance of survival and proliferation potential) of Nucleofected™ CD34$^+$ cells 96 hours after co-delivery of Cas9 paired with CXCR4 gRNA (CXCR4-231) and CCR5 gRNA (CCR5-U43) plasmids.
Figure 4B:
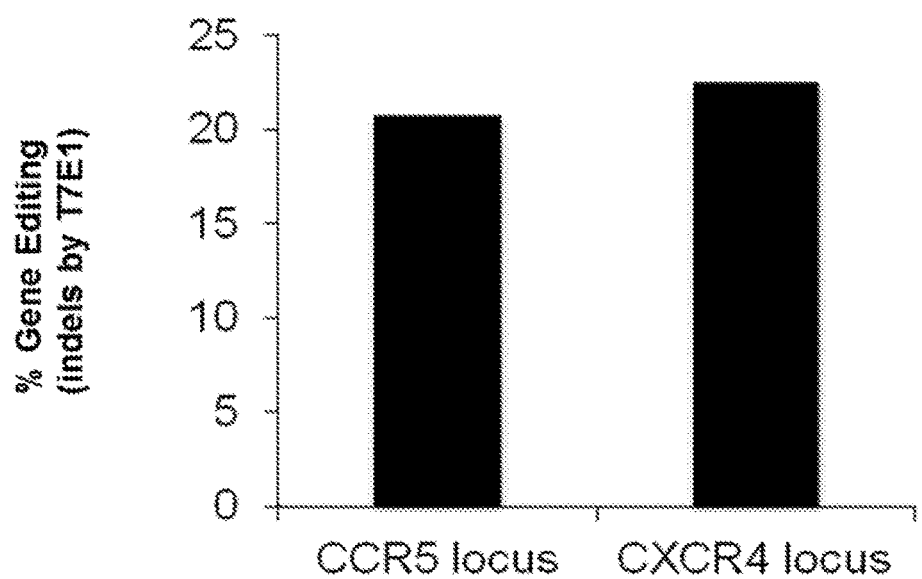
FIG. 4B depicts the percentage of indels detected by T7E1 assays in CD34$^+$ HSCs at CCR5 and CXCR4 genomic loci.

As shown in FIGS. 4A and 4B, effective multiplex genome editing of CD34+ HSCs after Nucleofection™ based co-delivery of plasmids expressing S. pyogenes (Spy) Cas9, one CXCR4 gRNA, and one CCR5 gRNA, was observed.

HSCs that were Nucleofected™ with Cas9 and CXCR4 (CXCR4-231) and CCR5 (CCR5-U43) gRNA plasmids exhibited >90% viability (7-AAD− AnnexinV−) and maintained co-expression of CD34 and CD90, as determined by flow cytometry analysis. In addition, Nucleofected™ cell numbers were maintained, as there was a fold-change (increase) in live CD34+ HSC cell number with a fold-change in the number of CD34+ cells similar to the level achieved in unelectroporated HSCs (FIG. 4A).

In order to detect indels at the CXCR4 and CCR5 loci, T7E1 assays were performed on CXCR4 and CCR5 locus-specific PCR products that were amplified from genomic DNA samples from Nucleofected™ CD34+ HSCs and the percentages of indels detected at the CXCR4 and CCR5 genomic loci were calculated. Up to 22% genome editing was detected at the two individual targeted loci in genomic DNA from CD34+ HSCs (FIG. 4B).

To evaluate maintenance of HSC potency and differentiation potential, two weeks after plating CD34+ HSCs in CFC assays, hematopoietic activity was quantified based on scoring the HSC progeny by enumerating the total number of hematopoietic colony forming units (CFU) and the frequencies of specific blood cell phenotypes, including: mixed myeloid/erythroid (Granulocyte-erythroid-monocyte macrophage, CFU-GEMM), myeloid (CFU-macrophage (M), granulocyte-macrophage (CFU-GM)) and erythroid (CFU- E) colonies. CD34+ HSCs that were Nucleofected™ CD34+ HSCs maintained CFC potential compared to un-Nucleofected™ HSCs (Table 14).

TABLE 14

UM171 preserves CD34+ HSC viability and multipotency after Nucleofection ™ with S. pyogenes CXCR4 and CCR5 multiplex gRNAs and Cas9 plasmid DNA

| Condition | Number of colony forming units per 1500 CD34+ HSCs plated | | | | |
|---|---|---|---|---|---|
| | E | G | M | GM | GEMM | Total |
| No Nucleofection ™ | 64 | 3 | 88 | 5 | 11 | 171 |
| Nucleofection ™ with S. pyogenes Cas9 + CXCR4 gRNA and CCR5 gRNA | 76 | 41 | 73 | 19 | 8 | 217 |

Co-delivery wild-type Streptococcus pyogenes Cas9, CXCR4 gRNA, and CCR5 gRNA expressing DNA plasmids supported up efficient genome editing at the two targeted loci, without loss of cell viability, multipotency, self-renewal and differentiation potential. Clinically, transplantation of HSCs that contain genetic mutations in both the CCR5 and CXCR4 genes generated by CRISPR/Cas9 related multiplexing methods can be used to achieve long-term control of HIV infection.

Example 8: Modification of gRNA by Addition of 5' Cap and 3' Poly-A Tail Increases Genome Editing at Target Genetic Loci and Improves CD34+ Cell Viability and Survival During virus-host co-evolution, viral RNA capping that mimics capping of mRNA evolved to allow viral RNA to escape detection from the cell's innate immune system (Delcroy et al., 2012, Nature Reviews Microbiology, 10:51-65). Toll-like receptors in hematopoietic stem/progenitor cells sense the presence of foreign single and double stranded RNA that can lead to innate immune response, cell senescence, and programmed cell death (Kajaste-Rudnitski and Naldini, 2015, Human Gene Therapy, 26:201-209). Results from initial experiments showed that human hematopoietic stem/progenitor cells electroporated with unmodified target specific gRNA and Cas9 mRNA led to reduced cell survival, proliferation potential, multipotency (e.g., loss of erythroid differentiation potential and skewed myeloid differentiation potential) compared to cells electroporated with GFP mRNA alone. In order to address this issue, it was hypothesized that cell senescence and apoptosis was due to the stem cell sensing of foreign nucleic acid and induction of an innate immune response and subsequent induction of programmed cell death and loss of proliferative and differentiation potential.

Toward optimization of genome editing in hematopoietic/ stem progenitor cells and to test this hypothesis, human CD34+ cells from mobilized peripheral blood and bone marrow were electroporated with S. pyogenes Cas9 mRNA co-delivered with HBB (HBB-8 gRNA; SEQ ID NO: 388) or AAVS1 (gRNA AAVS1-1; SEQ ID NO: 494) targeted gRNA in vitro transcribed with or without the addition of a 5' cap and 3' poly-A tail.

Figure 5A:
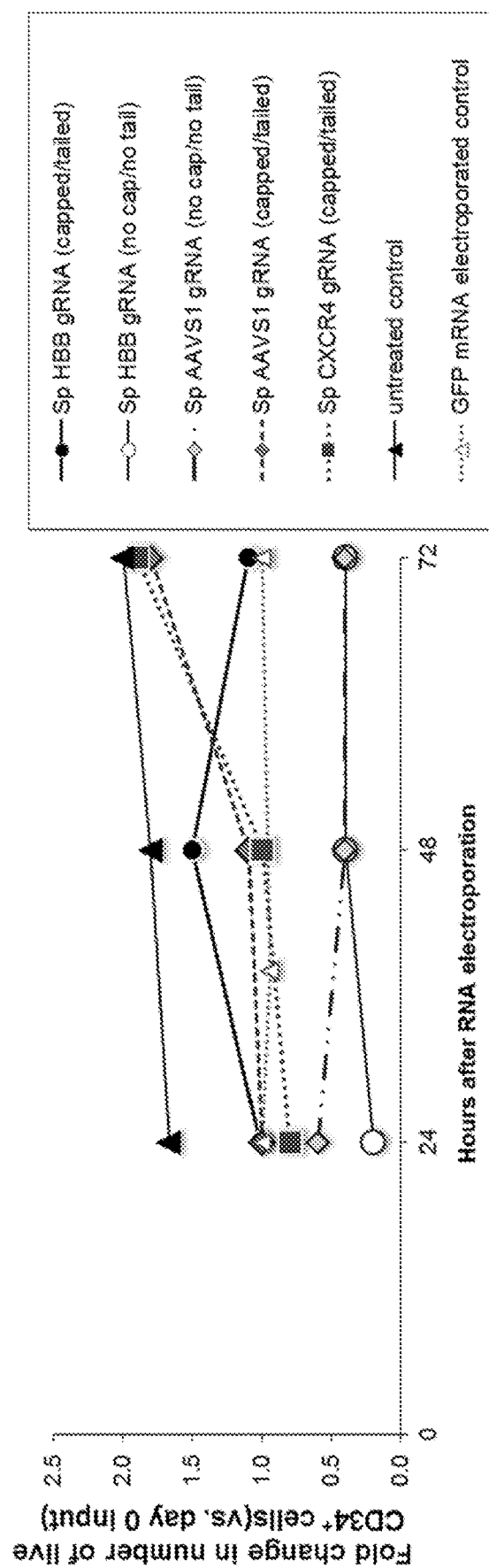
FIG. 5A depicts the kinetics of the fold-change in the number of CD34$^+$ cells after electroporation with the indicated uncapped/untailed gRNAs or capped/tailed gRNAs with paired Cas9 mRNA (either S. pyogenes (Sp) or S. aureus Sa Cas9).
Figure 5B:
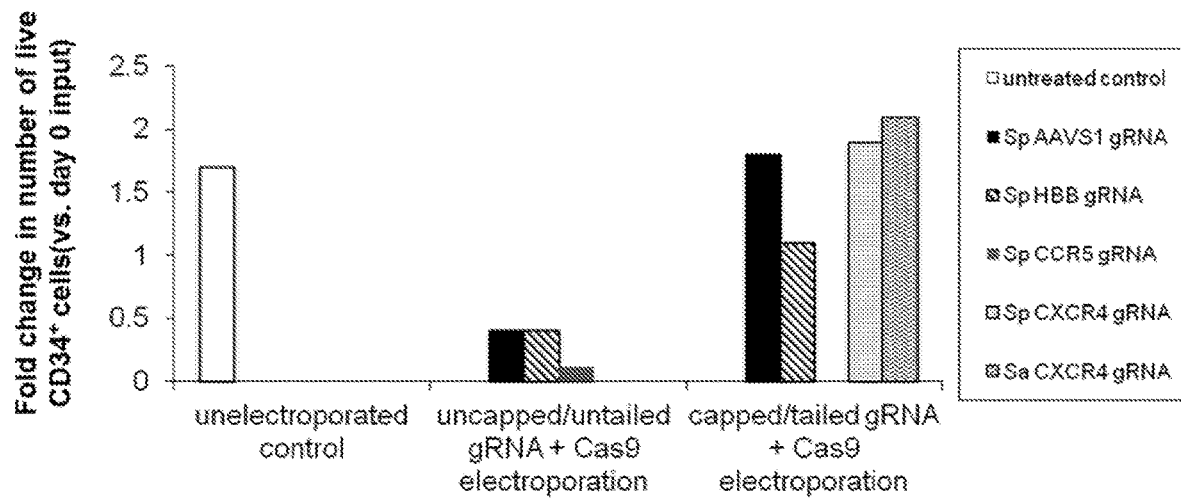
FIG. 5B depicts the fold change in total live CD34$^+$ cells 72 hours after electroporation with the indicated uncapped/untailed gRNAs or capped/tailed gRNAs with paired Cas9 mRNA (either S. pyogenes (Sp) or S. aureus Sa Cas9).
Figure 5C:
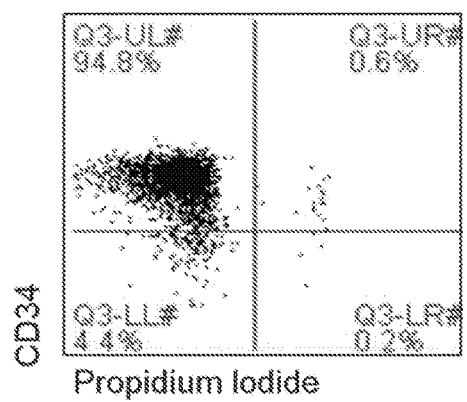
FIG. 5C depicts representative flow cytometry data showing maintenance of viable (propidium iodide negative) human CD34+ cells after electroporation with capped and tailed AAVS1 gRNA and Cas9 mRNA.

As shown in FIGS. 5A-5C, electroporation of capped and tailed gRNAs increased human CD34+ cell survival and viability. CD34+ cells were electroporated with the indicated uncapped/untailed gRNAs or capped/tailed gRNAs with paired Cas9 mRNA (either Streptococcus pyogenes (Sp) or Staphylococcus aureus (Sa) Cas9). Control samples include: cells that were electroporated with GFP mRNA alone or were not electroporated but were cultured for the indicated time frame.

Human CD34+ cells that were electroporated with Cas9 paired with a single uncapped and untailed HBB or AAVS1 gRNA exhibited decreased proliferation potential over 3 days in culture compared to cells that were electroporated with the same gRNA sequence that was in vitro transcribed to have a 5' cap and a 3' polyA tail (FIG. 5A). Other capped and tailed gRNAs (targeted to HBB (HBB-8 gRNA; SEQ ID NO: 388), AAVS1 (AAVS1-1 gRNA; SEQ ID NO: 494), CXCR4 (CXCR4-231 gRNA; SEQ ID NO: 491), and CCR5 (CCR5-U43 gRNA; SEQ ID NO: 493) loci) delivered with Cas9 mRNA did not negatively impact HSC viability, proliferation, or multipotency, as determined by comparison of the fold-change in the number of total live CD34+ cells over three days after delivery. Importantly, there was no difference in the proliferative potential of CD34+ cells contacted with capped and tailed gRNA and Cas9 mRNA compared to cells contacted with GFP mRNA or cells that were untreated. Analysis of cell viability (by co-staining with either 7-aminoactinomycin D or propidium iodide with AnnexinV antibody followed by flow cytometry analysis) at seventy-two hours after contacting Cas9 mRNA and gRNAs indicated that cells that contacted capped and tailed gRNAs divided in culture and maintained viability while HSCs that contacted uncapped and tailed gRNAs exhibited a decrease in viable cell number (FIG. 5B). Viable cells (propidium iodide negative) that contacted capped and tailed gRNAs also maintained expression of the CD34 cell surface marker (FIG. 5C).

As shown in FIGS. 6A-6G, electroporation of Cas9 mRNA and capped and tailed gRNA supported efficient editing in human CD34+ cells and their progeny.

Figure 6A:
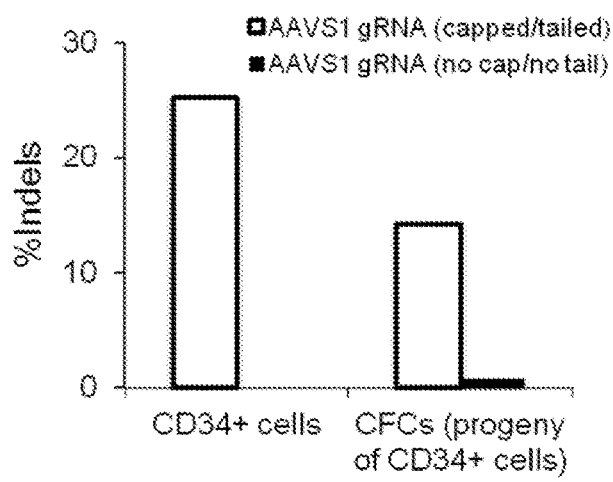
FIG. 6A depicts the percentage of insertions/deletions (indels) detected in CD34+ cells and their hematopoietic colony forming cell (CFC) progeny at the targeted AAVS1 locus after delivery of Cas9 mRNA with capped and tailed AAVS1 gRNA compared to uncapped and untailed AAVS1 gRNA.
Figure 6B:
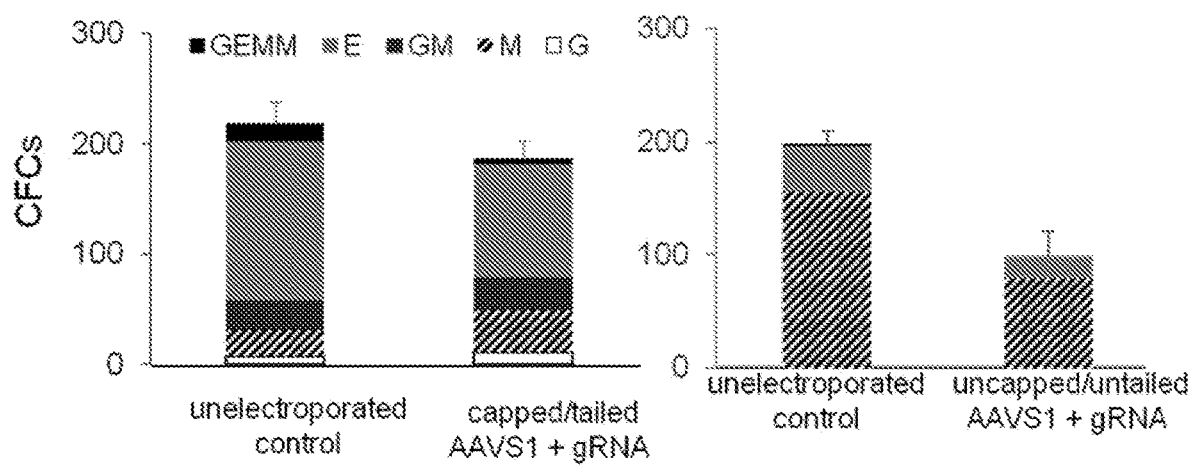
FIG. 6B depicts the maintenance of hematopoietic colony forming potential (CFCs) in CD34+ cells after editing with capped/tailed AAVS1 gRNA. Note loss of CFC potential for cells electroporated with uncapped/untailed AAVS1 gRNA. E: erythroid, G: granulocyte, M: macrophage, GM: granulocyte-macrophage, GEMM: granulocyte-erythrocyte-macrophage-monocyte.

In addition to the improved survival, stem cells that contacted capped and tailed AAVS1 specific gRNA also exhibited a higher percentage of on-target genome editing (% indels) compared to cells that contacted Cas9 mRNA and uncapped/untailed gRNAs (FIG. 6A). In addition, a higher level of targeted editing was detected in the progeny of CD34+ cells that contacted Cas9 mRNA with capped/tailed gRNA compared to the progeny of CD34+ cells that contacted Cas9 mRNA with uncapped/untailed gRNA (FIG. 6A, CFCs). Delivery of uncapped/untailed gRNA also reduced the ex vivo hematopoietic potential of CD34+ cells, as determined in colony forming cell (CFC) assays. Cells that contacted uncapped an untailed gRNAs with Cas9 mRNA exhibited a loss in total colony forming potential (e.g., potency) and a reduction in the diversity of colony subtype (e.g., loss of erythroid and progenitor potential and skewing toward myeloid macrophage phenotype in progeny) (FIG. 6B). In contrast, cells that contacted capped and tailed gRNAs maintained CFC potential both with respect to the total number of colonies differentiated from the CD34+ cells and with respect to colony diversity (detected of mixed hematopoietic colonies [GEMMs] and erythroid colonies [E]).

Figure 6C:
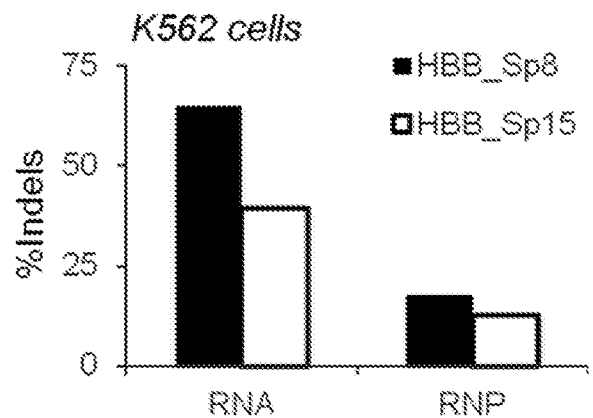
FIG. 6C depicts efficient targeted locus editing (% indels) in the K562 erythroleukemia cell line, a human erythroleukemia cell line has similar properties to HSCs, after delivery of capped and tailed HBB gRNA with S. pyogenes Cas9 mRNA or ribonucleoprotein (RNP).
Figure 6D:
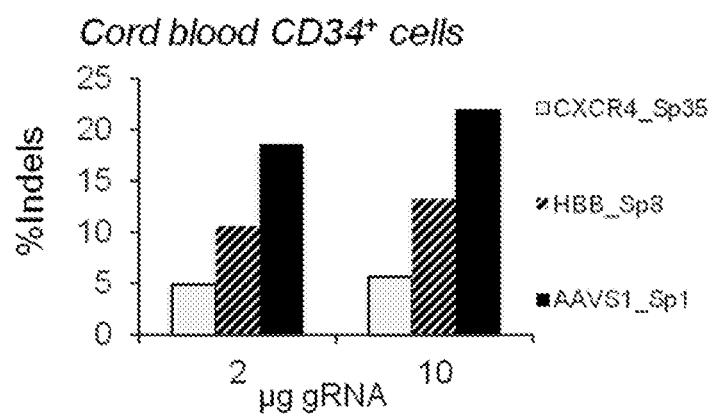
FIG. 6D depicts Cas9-mediated/capped and tailed gRNA mediated editing (% indels) at the indicated target genetic loci (AAVS1, HBB, CXCR4) in human cord blood CD34+ cells. Right: CFC potential of cord blood CD34+ cells after electroporation with Cas9 mRNA and capped and tailed HBB-8 gRNA, also called HBB_Sp8 herein, (SEQ ID NO:388) (unelectroporated control or cells electroporated with 2 or 10 µg HBB gRNAs). Cells were electroporated with Cas9 mRNA and 2 or 10 µg of gRNA.
Figure 6E:
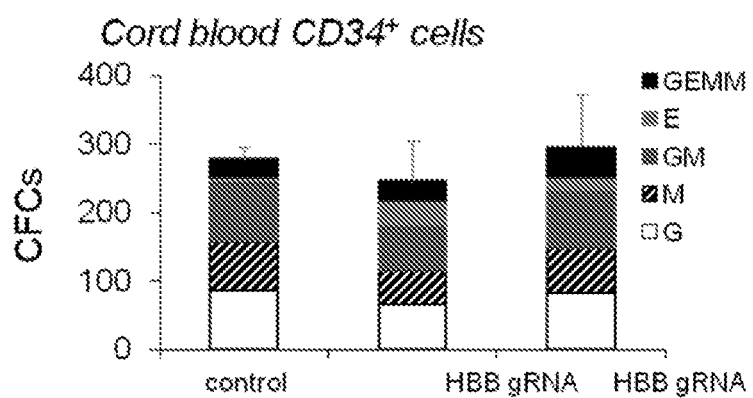
FIG. 6E depicts CFC assays for cells electroporated with 2 µg or 10 µg of capped/tailed HBB gRNA. CFCs: colony forming cells, E: erythroid, G: granulocyte, M: macrophage, GM: granulocyte-macrophage, GEMM: granulocyte-erythrocyte-macrophage-monocyte.
Figure 6F:
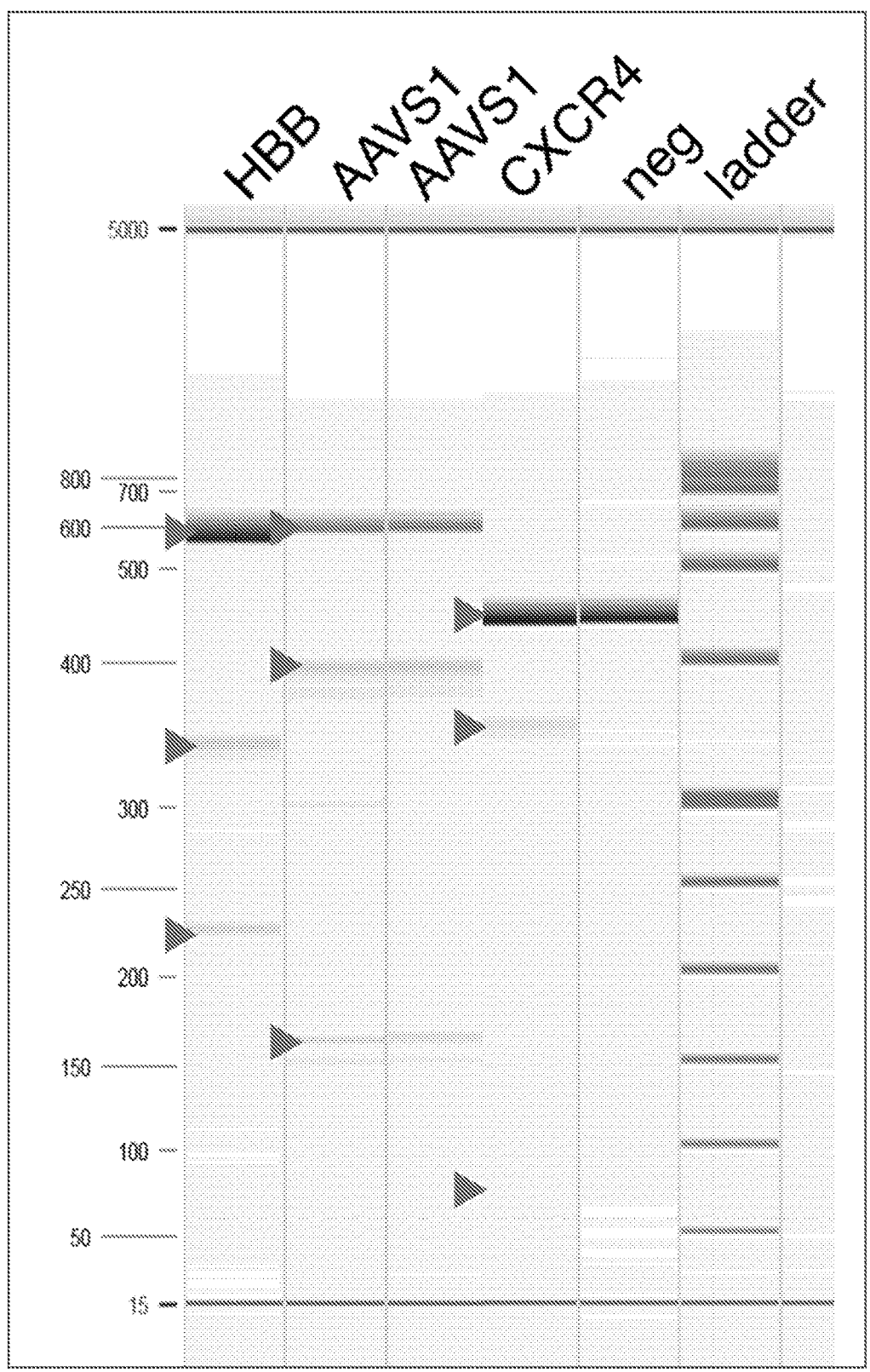
FIG. 6F depicts a representative gel image showing cleavage at the indicated loci (T7E1 analysis) in cord blood CD34+ cells at 72 hours after delivery of capped and tailed AAVS1, HBB, or CXCR4 gRNA and S. pyogenes Cas9 mRNA. The example gel corresponds to the summary data shown in FIG. 6D.
Figure 6G:
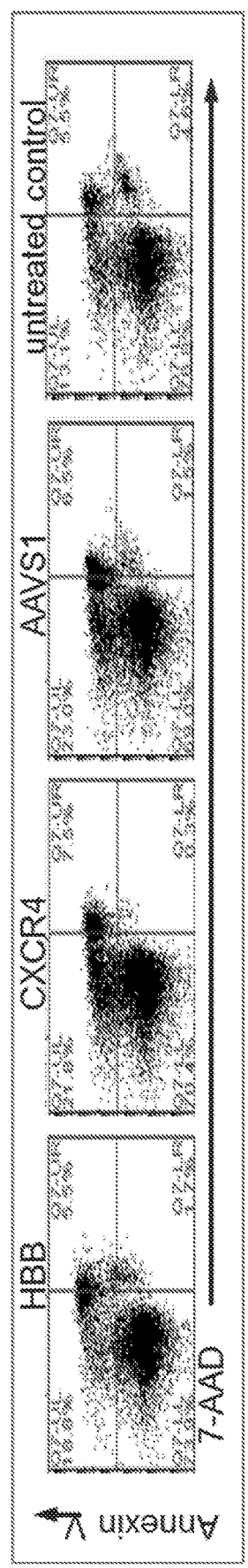
FIG. 6G Cell viability in CB CD34+ cells 48 hours after delivery of Cas9 mRNA and indicated gRNAs as determined by co-staining with 7-AAD and Annexin V and flow cytometry analysis.

Next, capped and tailed HBB specific gRNAs were co-delivered with either Cas9 mRNA or complexed with Cas9 ribonucleoprotein (RNP) and then electroporated into K562 cells, a erythroleukemia cell line that been shown to mimic certain characteristics of HSCs. Co-delivery of capped and tailed gRNA with Cas9 mRNA or RNP led to high level of genome editing at the HBB locus, as determined by T7E1 assay analysis of HBB locus PCR products (FIG. 6C). Next, 3 different capped and tailed gRNAs (targeting the HBB, AAVS1, and CXCR4 loci) were co-delivered with *S. pyogenes* Cas9 mRNA into CD34+ cells isolated from umbilical cord blood (CB). Here, different amounts of gRNA (2 or 10 µg gRNA plus 10 µg of *S. pyogenes* Cas9 mRNA) were electroporated into the cells and the percentages of genome editing evaluated at target loci by T7E1 assay analysis of locus PCR products. In contrast, no cleavage was detected at the HBB locus in the genomic DNA from CB CD34+ cells that were electroporated with uncapped and untailed HBB gRNA with Cas9 mRNA. The results indicated that CB CD34+ cells electroporated with Cas9 mRNA and capped and tailed gRNAs maintained proliferative potential and colony forming potential. Five to 20% indels were detected at target loci and the amount of capped and tailed gRNA co-delivered with the Cas9 mRNA did not impact the percentage of targeted editing (FIG. 6D). A representative gel image of the indicated locus specific PCR products after T7E1 assay was performed shows cleavage at the targeted loci in CB CD34+ cells 72 hours after delivery of capped and tailed locus-specific gRNAs (AAVS1, HBB, and CXCR4 gRNAs) co-delivered with *S. pyogenes* Cas9 mRNA by electroporation (FIG. 6F). Importantly, there was no difference in the viability of the cells electroporated with capped and tailed AAVS1-specific gRNA, HBB-specific gRNA, or CXCR4-specific gRNA co-delivered with *S. pyogenes* Cas9 mRNA compared to cells that did not contact Cas9 mRNA or gRNA (i.e., untreated control). Live cells are indicated by negative staining for 7-AAD and AnnexinV as determined by flow cytometry analysis (bottom left quadrants of flow cytometry plots, FIG. 6G). CB CD34+ cells electroporated with capped and tailed AAVS1 specific gRNA, HBB-specific gRNA, or CXCR4-specific gRNA co-delivered with *S. pyogenes* Cas9 mRNA maintained ex vivo hematopoietic colony forming potential as determined by CFC assays. The representation ex vivo hematopoietic potential in CFC assays for cells that contacted HBB-specific gRNA and Cas9 is shown in the FIG. 6E.

Example 9: Contact Between *S. pyogenes* Cas9 Ribonucleoprotein Complexed to gRNAs Targeting the HBB Genetic Locus Supports Gene Editing in Adult Human Hematopoietic Stem Cells Transplantation of autologous CD34+ hematopoietic stem cells (HSCs) collected from patients affected with hemoglobinopathies (e.g., sickle cell disease [SCD], β-thalassemia), that have been genetically modified with a lentivirus vector that expresses non-sickling β-hemoglobin gene (HBB) has been shown to restore expression of functional adult hemoglobin (HbA) thus preventing the formation of sickle hemoglobin (HbSS), in erythroid cells derived from transduced CD34+ cells and ameliorating clinical symptoms in affected patients (Press Release from *Bluebird Bio*, Jun. 13, 2015, "bluebird bio Reports New Beta-thalassemia major and Severe Sickle Cell Disease Data from HGB-205 study at EHA"). However, delivery of a transgene encoding a non-sickling β-hemoglobin does not correct the causative mutation or prevent expression of the mutant (e.g., sickling) form of HBB. Furthermore, lentivirus vector transduction of CD34+ cells can lead to the occurrence of multiple transgene integration sites per cell, and the long-term effects of multiple transgene integration sites is currently undetermined.

In contrast, genome editing with the CRISPR/Cas9 platform precisely alters endogenous gene targets by creating an insertion or deletion (indel) at the cut site that can lead to gene disruption at the edited locus. Co-delivery of two gRNAs each targeting regions proximal to the single nucleotide polymorphism (SNP) that encodes HbSS (e.g., GAG-GTG, which results in a change in the amino acid residue from glutamic acid to valine) co-delivered with a Cas9 D10A nickase supports a low level of homology directed repair (HDR) in human cell lines (e.g., gene conversion using a region of homology in the HBD locus as DNA repair template).

In this Example, genome editing in adult human mobilized peripheral blood CD34+ HSCs after co-delivery of Cas9 D10A nickase with two gRNAs targeting the HBB locus was evaluated. The edited CD34+ cells were then differentiated into myeloid and erythroid cells to determine the hematopoietic activity of the HSCs. Gene editing at the HBB locus was evaluated by T7E1 analysis and DNA sequencing. Expression of HBB protein was also analyzed in erythroid progeny.

Human CD34+ HSCs cells from mobilized peripheral blood (AllCells®) were thawed into StemSpan Serum-Free Expansion Medium (SFEM™, StemCell Technologies) containing 300 ng/mL each of human stem cell factor (SCF) and flt-3 ligand (FL), 100 ng/mL thrombopoietin (TPO), and 60 ng/mL of IL-6, and 10 µM PGE2 (Cayman Biochemicals; all other supplements were from PeproTech® unless otherwise indicated). Cells were grown for 3 days in a humidified incubator and 5% $CO_2$ 20% $O_2$. On day 3 (morning), media was replaced with fresh Stemspan-SFEM™ supplemented with human SCF, TPO, FL and PGE2. In the afternoon of day 3, 2.5 million CD34+ cells per sample were suspended in electroporation buffer.

The gRNA was generated by in vitro transcription using a T7 polymerase. A 5' ARCA cap was added to the RNA simultaneous to transcription while a polyA tail was added after transcription to the 3' end of the RNA species by an *E. coli* polyA polymerase.

Figure 7A:
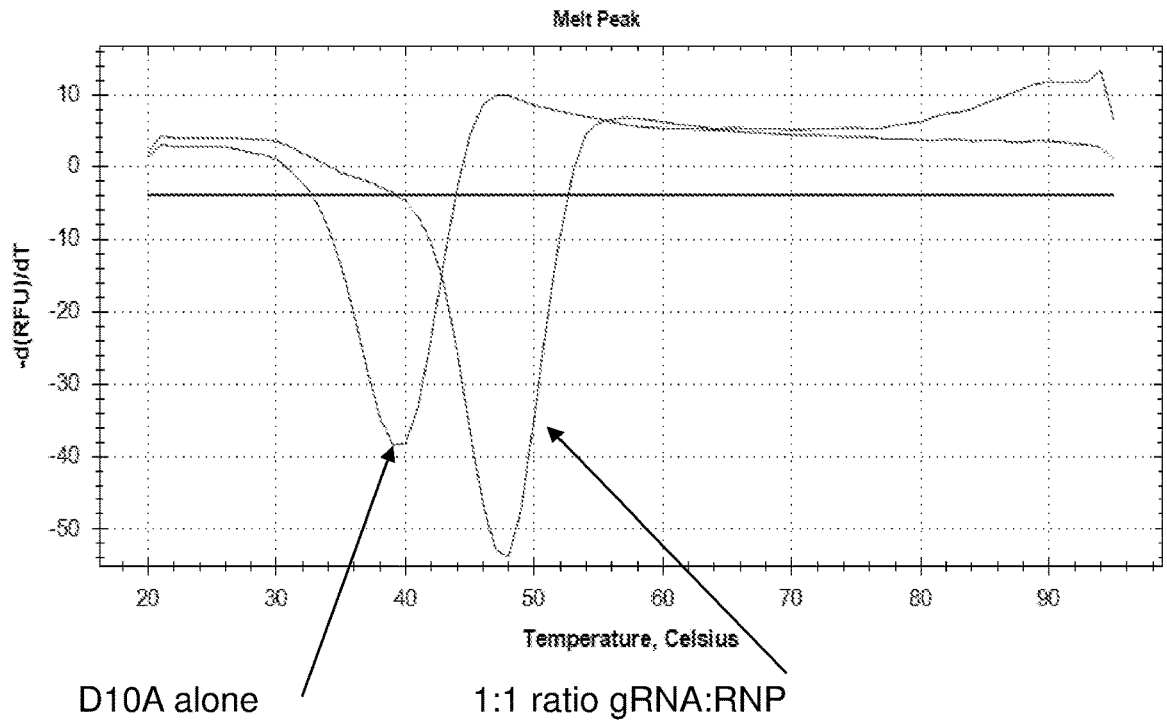
FIGS. 7A and 7B depict an analysis of stability of D10A nickase RNP in vitro and ex vivo in human adult CD34+ HSCs.
Figure 7A:
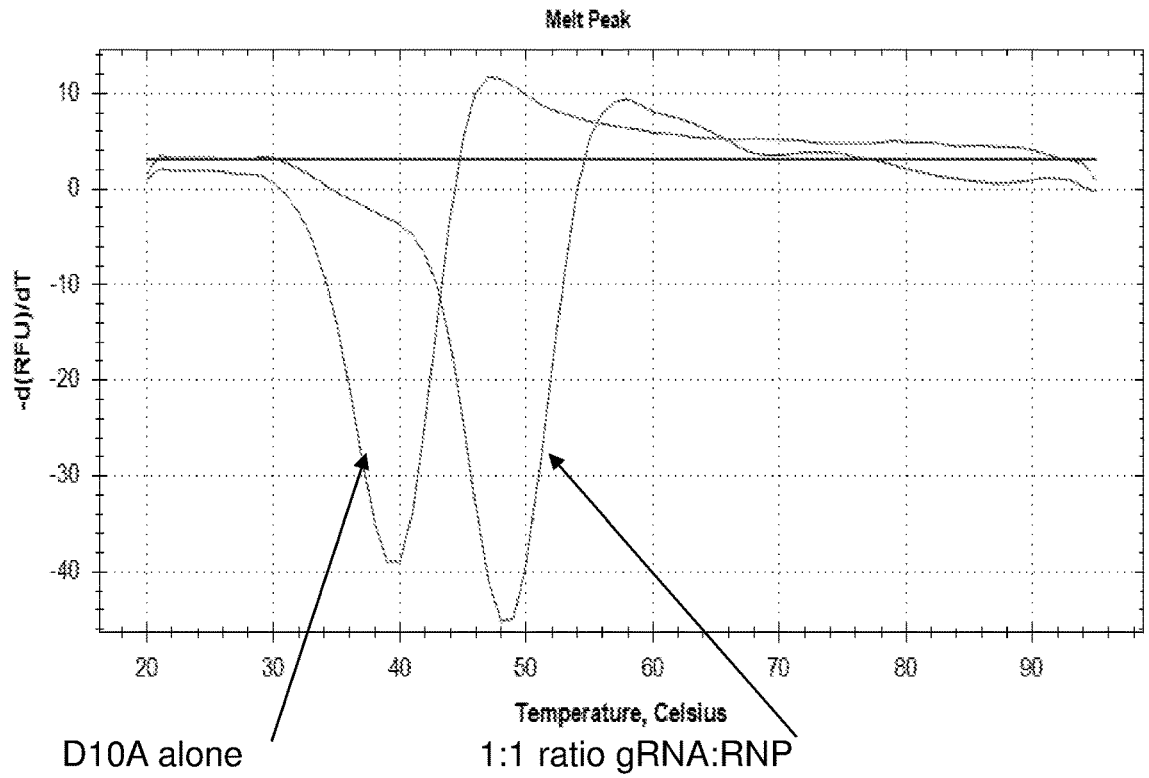

After the gRNAs were in vitro transcribed and tailed, the quality and quantity of gRNAs were evaluated with the Bioanalyzer (Nanochip®) to determine RNA concentration and by Differential Scanning Fluorimetry (DSF) assay, a thermal shift assay that quantifies the change in the thermal denaturation temperature of Cas9 protein with and without complexing to gRNA. In DSF assays, the Cas9 protein was mixed with gRNA and allowed to form complexes for 10 minutes. Cas9 protein:gRNA were mixed at a molar ratio of 1:1, and the DSF assay performed as a measure of Cas9 stability and as an indirect measure of gRNA quality, since a 1:1 ratio of gRNA:Cas9 should support a thermal shift if the gRNA is of good quality (FIG. 7A).

For half of the samples, in vitro transcribed capped and tailed guide (g)RNAs HBB-8 and HBB-15 were added at a 2:1 molar ratio to 12.5 µg D10A Cas9 ribonucleoprotein (RNP) (5 µg RNP per million cells) to 2.5 million cells. "HBB-8" has the targeting domain sequence of GUAACGGCAGACUUCUCCUC (SEQ ID NO:388), and "HBB-15" has the targeting domain sequence of AAG-GUGAACGUGGAUGAAGU (SEQ ID NO:387). D10A protein and gRNAs RNP complexes were transferred to 2.5 million adult CD34+ cells in electroporation buffer. The RNP/cell mixture was transferred to the electroporation cartridge, and the cells then electroporated with ("Program 2" and "Program 3" (Alt Program)).

For the second portion of CD34+ cell samples, equal amounts (5 µg or 10 µg [2×gRNA] each) of in vitro transcribed capped and tailed guide (g)RNAs HBB-8 and HBB-15 were added to 10 µg of in vitro transcribed Cas9 D10A mRNA. The mRNA:gRNA: cell mixture was electroporated with Program 2 (P2).

For all samples, the cells were collected from the cartridge and placed at 37° C. for 20 minutes (recovery period). Then, the cells were either transferred to pre-warmed cytokine supplemented Stemspan-SFEM™ media and placed at 30° C. for 2 hours (cold shock samples) or placed directly into 37° C. For the cold shocked samples, the cells were transferred to the 37° C. incubator after the 2-hour incubation period at 30° C. At 24, 48, and 72 hours after electroporation, the CD34+ cells were counted by trypan blue exclusion (cell survival) and divided into 3 portions for the following analyses: a) flow cytometry analysis for assessment of viability by co-staining with 7-Aminoactinomycin-D (7-AAD) and allophycocyanin (APC)-conjugated Annexin-V antibody (eBioscience); b) flow cytometry analysis for maintenance of HSC phenotype (after co-staining with phycoerythrin (PE)-conjugated anti-human CD34 antibody (BD Biosciences) and APC-conjugated CD133 (Miltenyi Biotech; c) hematopoietic colony forming cell (CFC) analysis by plating 800 cells in semi-solid methylcellulose based Methocult medium (StemCell Technologies H4435) that supports differentiation of erythroid and myeloid blood cell colonies from HSCs and serves as a surrogate assay to evaluate HSC multipotency and differentiation potential ex vivo; d) genomic DNA analysis for detection of editing at the HBB locus. Genomic DNA was extracted from the HSCs at 48 and 72 hours after electroporation and HBB locus-specific PCR reactions were performed. The purified PCR products were analyzed for insertions/deletions (indels) in T7E1 assays and by DNA sequencing of individual clones (PCR product was transformed and sub-cloned into TOPO-vector, individual colonies picked, and plasmid DNA containing individual PCR products were sequenced).

Figure 7B:
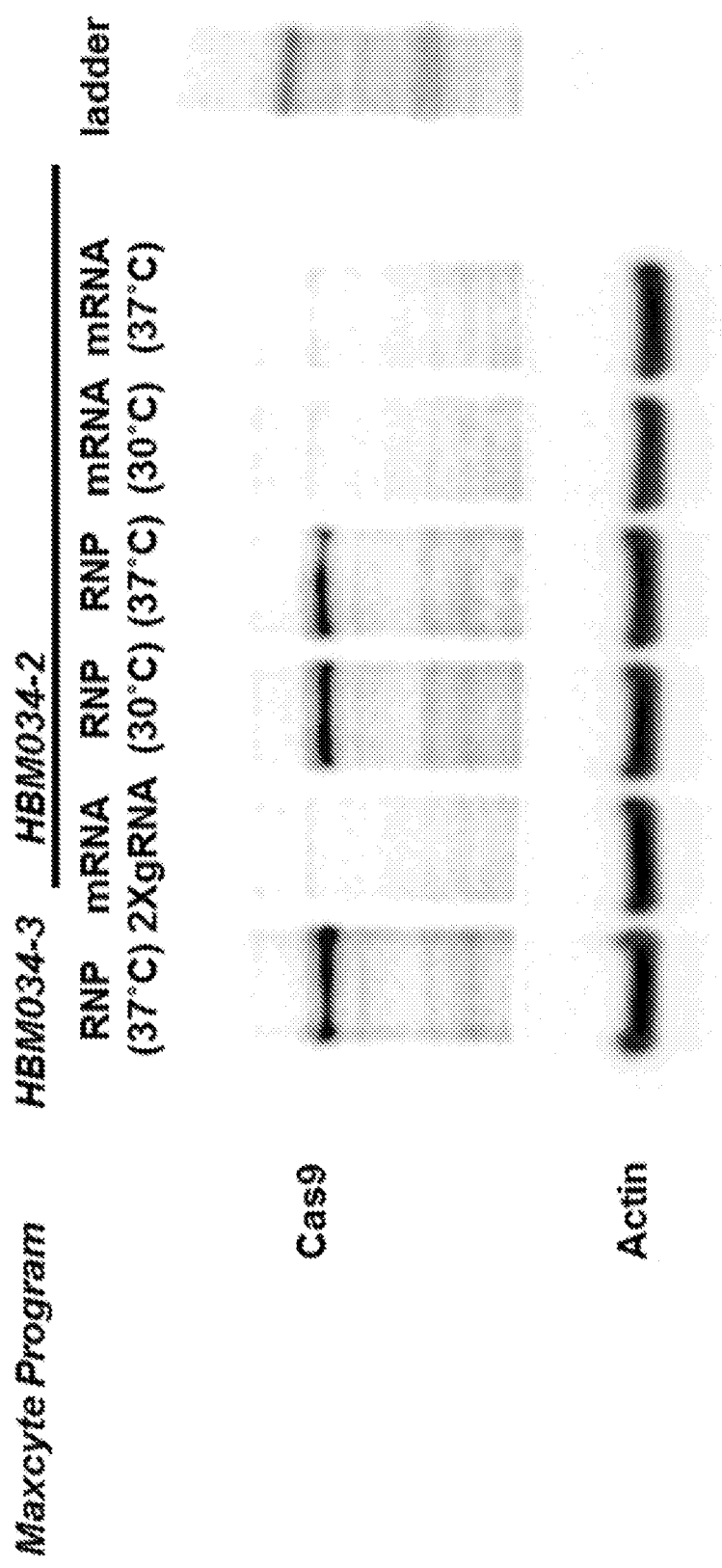

Western blot analysis of cell lysates extracted from the Cas9/gRNA electroporated CD34+ cells indicated the presence of Cas9 protein at 72 hours after electroporation of CD34+ cells that received Cas9 RNP and gRNA pair. Very low levels of Cas9 protein were detected in the lysates of cells that were electroporated with Cas9 mRNA (FIG. 7B).

Figure 8A:
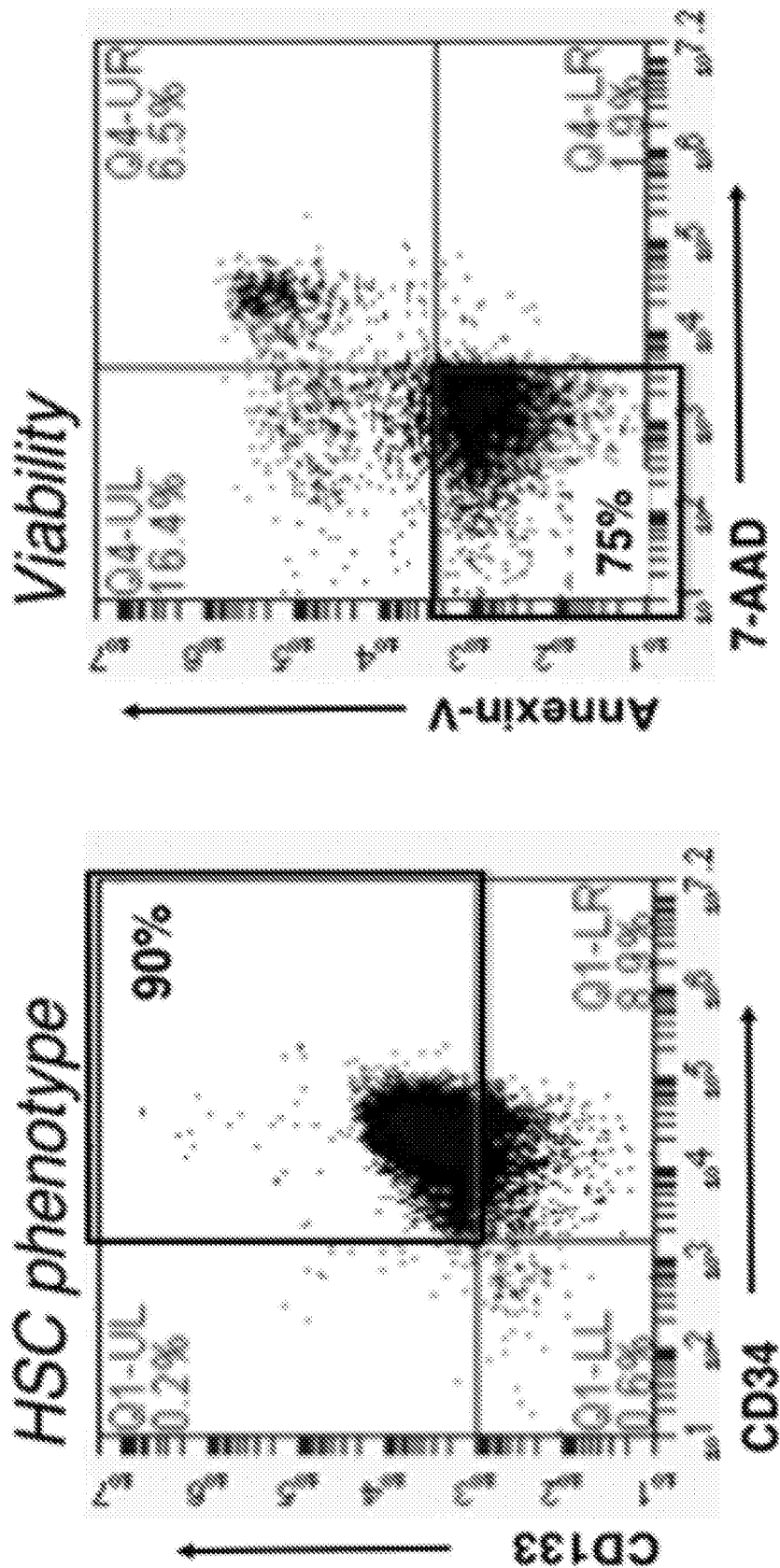
FIGS. 8A, 8B, and 8C show that human adult CD34+ HSCs maintain stem cell phenotype after electroporation with D10A nickase RNP and HBB targeting gRNA pair.
Figure 8B:
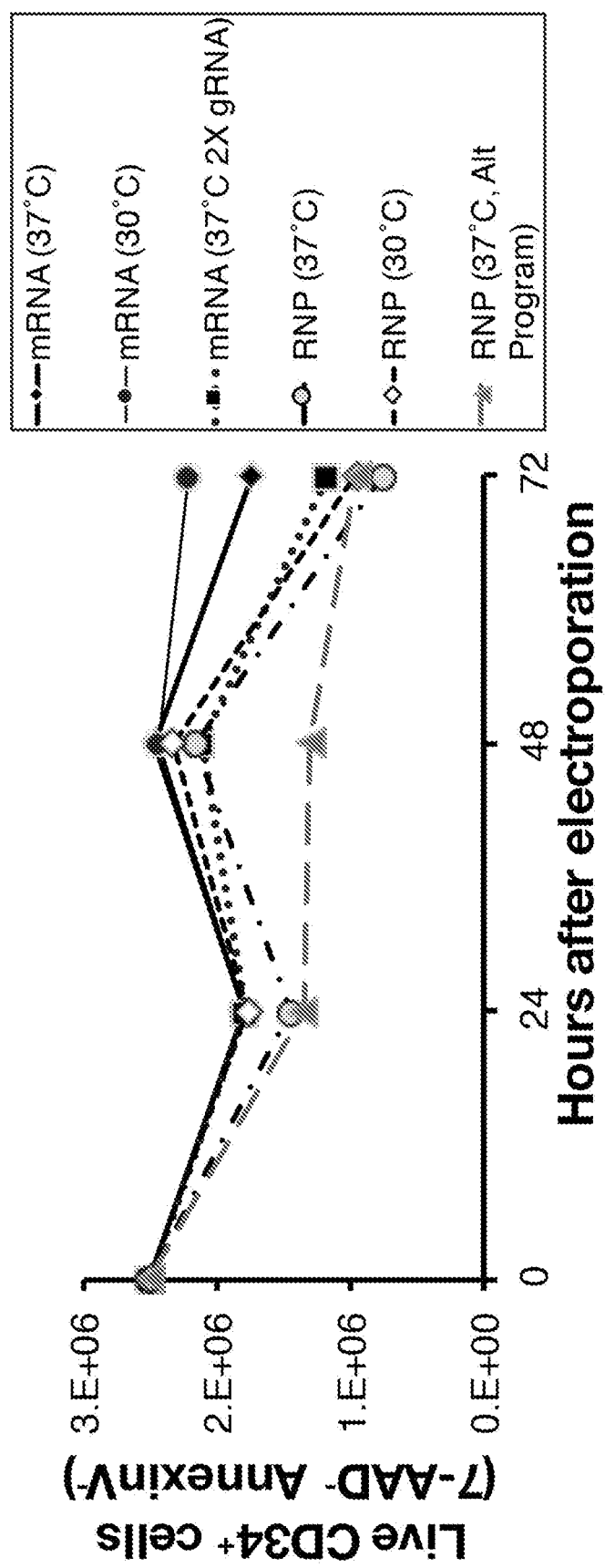
Figure 8C:
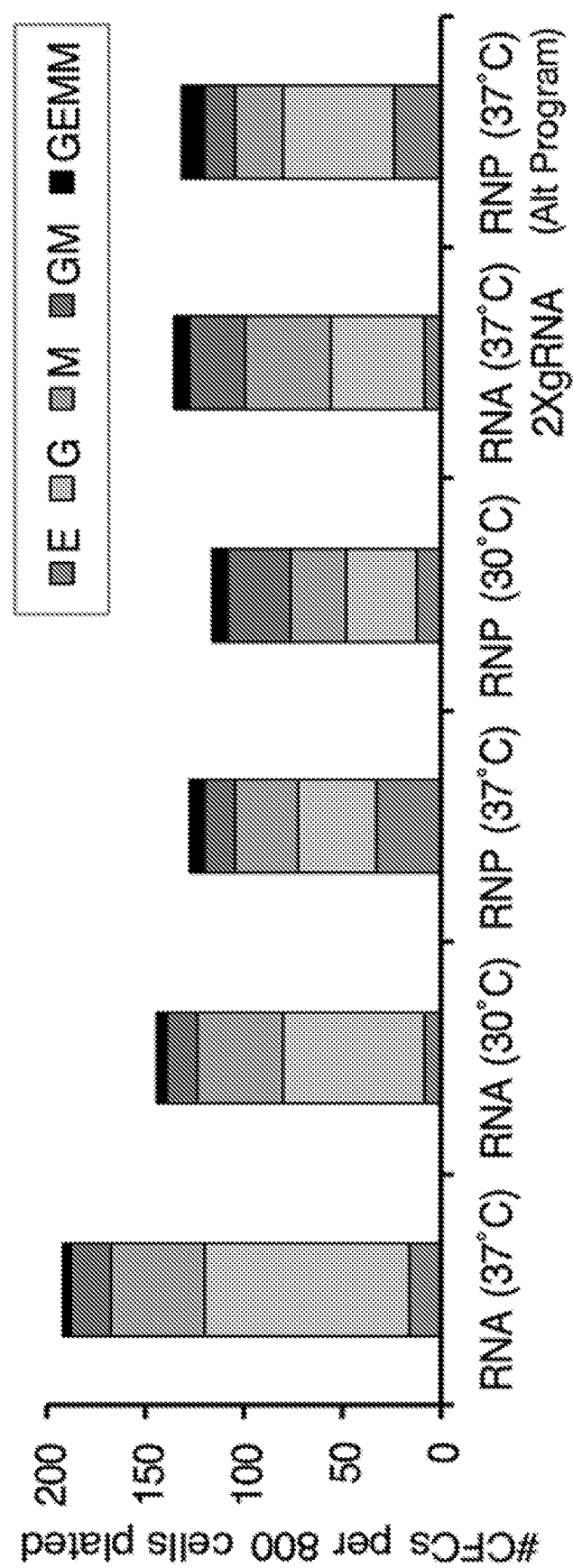

Electroporated CD34+ cells maintained a stem cell phenotype (e.g., co-expression of CD34 and CD133) and viability (e.g., 75% AnnexinV−7AAD−) as determined by flow cytometry analysis (FIG. 8A). The absolute number of viable CD34+ cells was maintained across most samples over a 72-hour culture period after electroporation (FIG. 8B). In addition, gene edited CD34+ cells maintained ex vivo hematopoietic activity and multipotency as indicated by their ability to give rise to erythroid (e.g., CFU-E or CFU-GEMM) and myeloid (e.g., CFU-G, -M or -GM) (FIG. 8C).

Figure 9A:
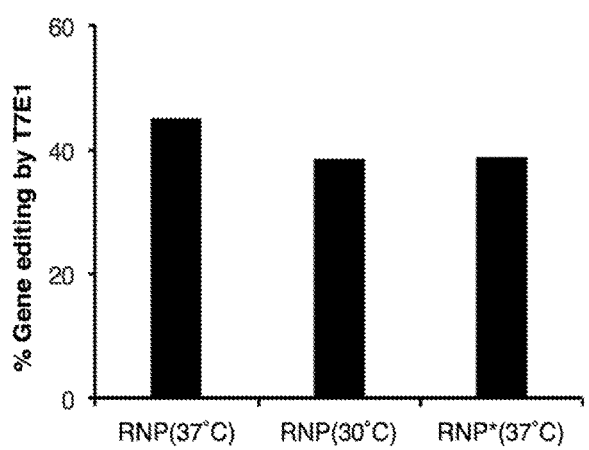
FIGS. 9A, 9B, and 9C show that D10A nickase RNP co-delivered with HBB targeted gRNA pair supports gene editing and HDR in human adult CD34+ HSCs.
Figure 9B:
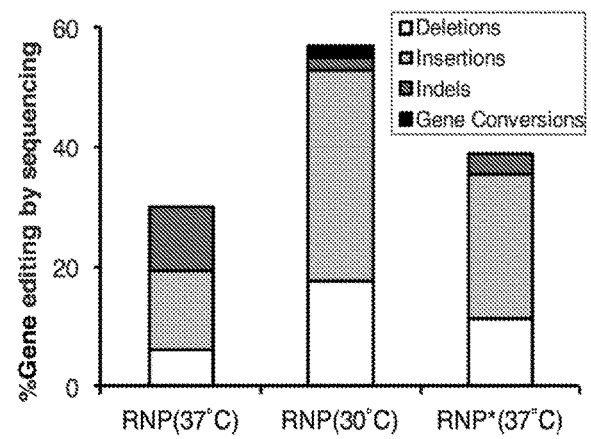
Figure 9C:
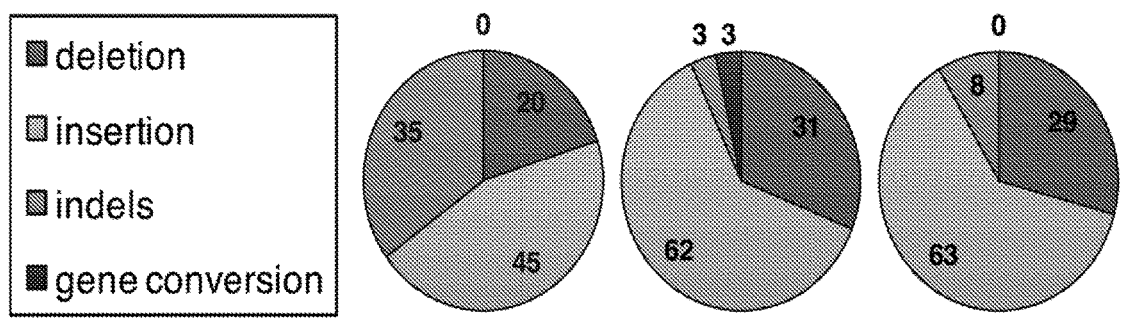

Gene editing at the HBB locus was then evaluated at 72 hours after electroporation of D10A mRNA or RNP co-delivered with two gRNAs (HBB-8 and HBB-15). Briefly, genomic (g)DNA was isolated from electroporated CD34+ cells at 72 hours after electroporation, and PCR amplification of a ~607 bp fragment of the HBB locus (which captured both of the individual genomic locations that were targeted by the two gRNAs HBB-8 and HBB-15) was performed. After cleanup of the HBB PCR product with AMPURE beads, insertions/deletions (indels) at the targeted genomic location were evaluated by T7E1 assay and by DNA sequencing. For the CD34+ cells electroporated with D10A mRNA and HBB targeting gRNA pair, no indels were detected (Table 15). In contrast to the negative results obtained after delivery of D10A mRNA, ~30-60% indels were detected by T7E1 and sequencing analysis of CD34+ cells that were electroporated with D10A RNP with the HBB targeting gRNA pair (Table 15, FIGS. 9A-9C). The cells that were cultured for 2 hours at 30° C. (after a 20-minute recovery period at 37° C.) exhibited 57% editing as determined by DNA sequencing. In addition, gene conversion (e.g., HBD genomic sequence used as a template copy for DNA repair of the disrupted HBB locus) was detected in the gDNA from CD34+ cells that were 'cold shocked' (30° C. incubation) at a frequency of 3% relative to the total gene editing events (FIG. 9C).

TABLE 15

Summary of gene editing results in adult CD34+ cells 72 hours after co-delivery of D10A Cas9 and HBB specific gRNA pair.

| D10A source | µg D10A | µg HBB-8 gRNA | µg HBB-15 gRNA | Temperature of 2-hour recovery | Electroporation Program | % Gene Editing (indels by T7E1) | % Gene Editing (sequencing) |
|---|---|---|---|---|---|---|---|
| mRNA | 10 | 5 | 5 | 37° C. | 2 | 0 | ND |
| mRNA | 10 | 5 | 5 | 30° C. | 2 | 0 | ND |
| mRNA | 10 | 10 | 10 | 37° C. | 2 | 0 | ND |
| RNP | 12.5 | 3.3 | 3.3 | 37° C. | 2 | 45 | 30 |
| RNP | 12.5 | 3.3 | 3.3 | 30° C. | 2 | 39 | 57 |
| RNP | 12.5 | 3.3 | 3.3 | 37° C. | 3 | 39 | 39 |

Figure 10:
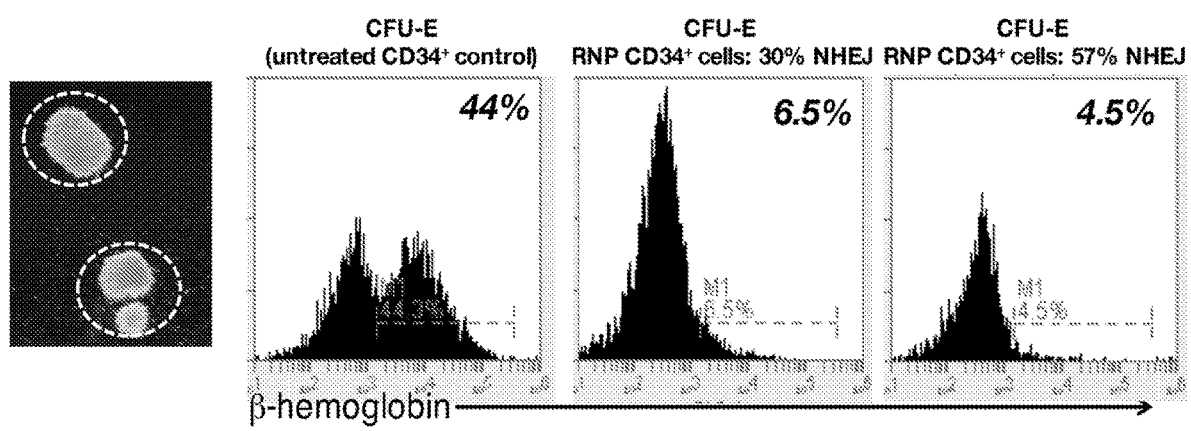
FIG. 10 depicts flow cytometry analysis of β-hemoglobin expression in the erythroid progeny differentiated from D10A nickase RNP gene-edited adult CD34+ HSCs. CFU-E colonies (far left) differentiated from D10A RNP HBB gRNA electroporated CD34+ cells were dissociated, fixed, permeabilized, and stained for b-hemoglobin expression. The gene editing frequencies detect in the parental CD34+ cell population are indicated above the histograms for the indicated samples. The percentage of β-hemoglobin expression in each colony was determined by flow cytometry and is indicated at the top right of each histogram.

To determine whether targeted disruption of the HBB locus induced changes in expression of b-hemoglobin protein, CFU-E colonies were picked, dissociated, fixed, permeabilized and stained with PE-conjugated mouse anti-human β-hemoglobin antibody (Santa Cruz Biotechnology®). The erythroid progeny of HBB gene edited cells exhibited a 7- to 10-fold reduction in β-hemoglobin expression compared to the CFU-Es differentiated from untreated control CD34+ cells (FIG. 10). These data show that the progeny of gene edited cells retain erythroid differentiation potential and that gene editing events detected in the parental CD34+ cells result in reduced protein expression in erythroid progeny.

Example 10: Contact Between S. pyogenes D10A Cas9 Nickase Ribonucleoprotein Complexed to gRNAs Targeting the HBB Genetic Locus Supports Gene Editing in Fresh Umbilical Cord Blood Derived Human CD34+ Hematopoietic Stem Cells In this Example, genome editing in freshly collected umbilical cord blood (CB) CD34+ HSCs after co-delivery of D10A Cas9 nickase with 2 gRNAs targeting the HBB locus was evaluated. The edited CB CD34+ cells were then differentiated into myeloid and erythroid cells to determine the hematopoietic activity of the HSCs. Targeted disruption of the HBB locus was evaluated by T7E1 analysis and DNA sequencing.

Human CD34+ HSCs cells were isolated from freshly obtained human umbilical cord blood by ficoll gradient density centrifugation followed by MACS® (antibody conjugated immunomagnetic bead sorting) with mouse anti-human CD34+ immunomagnetic beads using the human CD34 cell enrichment kit and LS magnetic columns from Miltenyi Biotech. The cells were plated into StemSpan Serum-Free Expansion Medium (SFEM™, StemCell Technologies) containing 100 ng/mL each of human stem cell factor (SCF) and flt-3 ligand (FL), 20 ng/mL each of thrombopoietin (TPO) and IL-6, and 10 μM PGE2 (Cayman Biochemicals; all other supplements were from Peprotech unless otherwise indicated). Cells were grown for 3 days in a humidified incubator and 5% $CO_2$ 20% $O_2$. On day 3 (morning), media was replaced with fresh Stemspan-SFEM™ supplemented with human SCF, TPO, FL and PGE2. In the afternoon of day 3, 2.5 million CD34+ cells per sample were suspended in electroporation buffer.

The gRNAs were generated by in vitro transcription using a T7 polymerase. A 5' ARCA cap was added to the RNA simultaneous to transcription while a polyA tail was added after transcription to the 3' end of the RNA species by an *E. coli* polyA polymerase. After the gRNAs were in vitro transcribed and tailed, the quality and quantity of gRNAs were evaluated with the Bioanalyzer (Nanochip) to determine RNA concentration and by DSF assay performed as a measure of D10A Cas9 nickase RNP stability and as an indirect measure of gRNA quality.

In vitro transcribed capped and tailed guide gRNAs HBB-8 and HBB-15 were added at a 2:1 molar ratio (total gRNA:Cas9 protein) to 12.5 μg D10A nickase ribonucleoprotein (RNP) (5 μg RNP per million cells) to each of two samples each containing 2.5 million CB CD34+ cells. A third CB CD34+ cell aliquot was mixed with 25 μg D10A nickase RNP and HBB gRNAs (total gRNA:D10A ratio at 2:1). For each experimental sample, the D10A RNP/cell mixture was transferred to the electroporation cartridge, and the cells then electroporated with Program 2.

For all samples, the cells were collected from the cartridge and placed at 37° C. for 20 minutes (recovery period). For the CB CD34+ HSCs that were contacted with 12.5 μg D10A nickase RNP, one sample was transferred to pre-warmed cytokine supplemented Stemspan-SFEM™ media and placed at 30° C. for 2 hours (cold shock samples) or placed directly into the same media at 37° C. For the cold shocked samples, the cells were transferred to the 37° C. incubator after the 2-hour incubation period at 30° C. At 24, 48, and 72 hours after electroporation, the CB CD34+ HSCs were counted by trypan blue exclusion (cell survival) and divided into 3 portions for the following analyses: a) flow cytometry analysis for assessment of viability by co-staining with 7-Aminoactinomycin-D (7-AAD) and allophycocyanin (APC)-conjugated Annexin-V antibody (eBioscience); b) flow cytometry analysis for maintenance of HSC phenotype (after co-staining with phycoerythrin (PE)-conjugated anti-human CD34 antibody (BD Biosciences) and APC-conjugated CD133 (Miltenyi Biotech; c) hematopoietic colony forming cell (CFC) analysis by plating 800 CB CD34+ HSCs in semi-solid methylcellulose based Methocult medium (StemCell Technologies H4435) that supports differentiation of erythroid and myeloid blood cell colonies from HSCs and serves as a surrogate assay to evaluate HSC multipotency and differentiation potential ex vivo; d) genomic DNA analysis for detection of editing at the HBB locus. Genomic DNA was extracted from the HSCs at 48 and 72 hours after electroporation and HBB locus-specific PCR reactions were performed. The purified PCR products were analyzed for insertions/deletions (indels) in T7E1 assays and by DNA sequencing of individual clones (PCR product was transformed and subcloned into TOPO-vector, individual colonies picked, and plasmid DNA containing individual PCR products were sequenced).

Figure 11A:
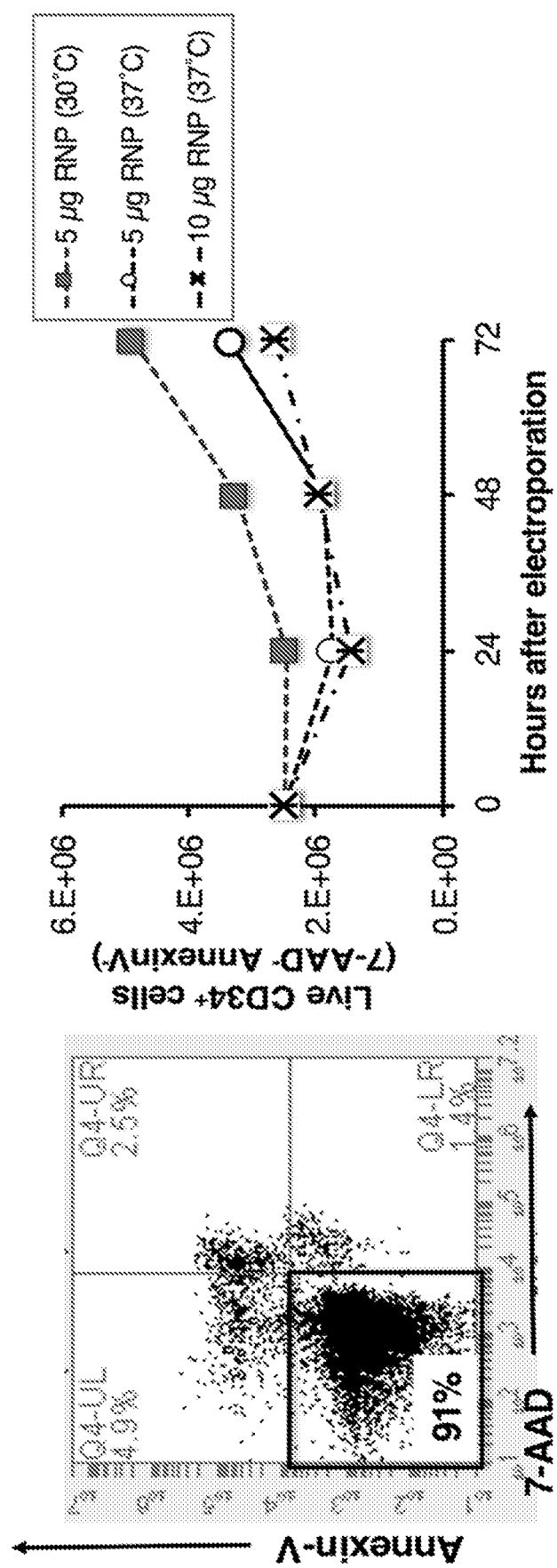
FIGS. 11A and 11B show that human cord blood (CB) CD34+ HSCs maintained stem cell phenotype after electroporation with D10A nickase RNP and HBB targeting gRNA pair.
Figure 11B:
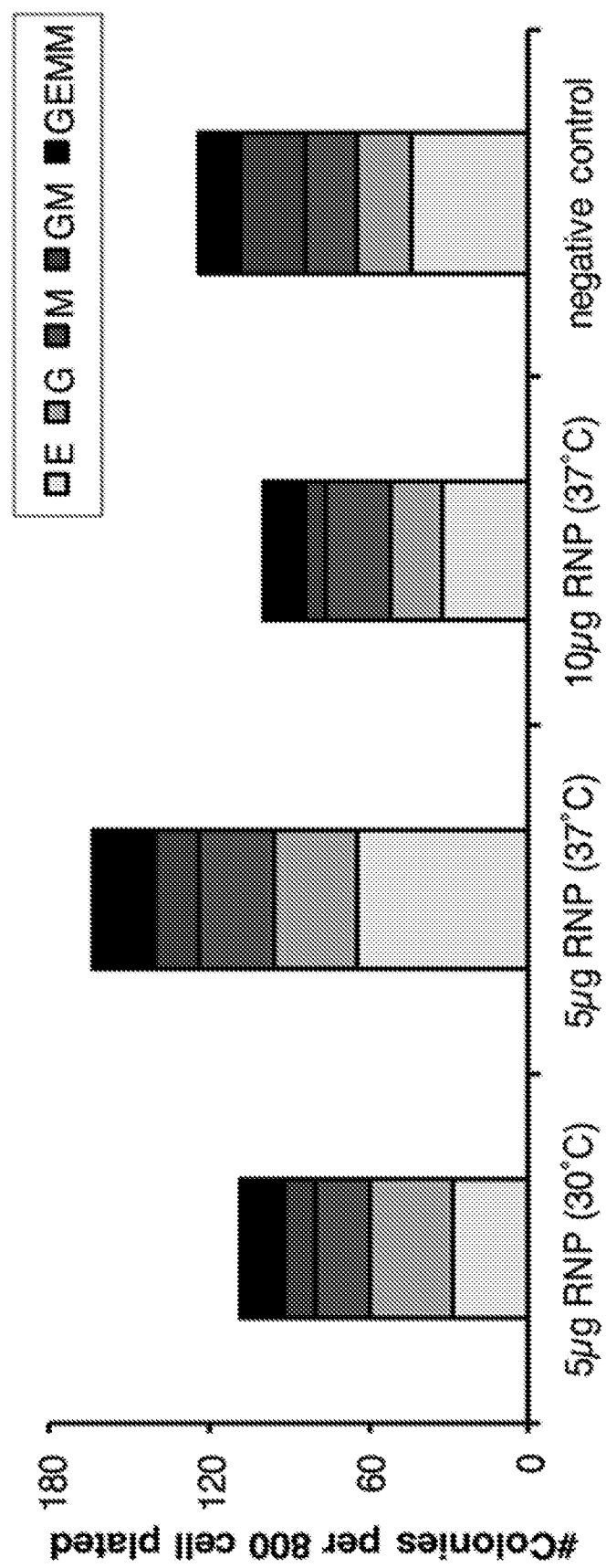

Electroporated CB CD34+ cells maintained a stem cell phenotype (e.g., co-expression of CD34 and CD133, ~90% CD34+CD133+) and viability (e.g., 91% AnnexinV− 7AAD−) as determined by flow cytometry analysis (FIG. 11A). The absolute number of viable CD34+ cells was maintained across most samples over a 72-hour culture period after electroporation. In addition, gene edited CD34+ cells maintained ex vivo hematopoietic activity and multipotency as indicated by their ability to give rise to erythroid (e.g., CFU-E or CFU-GEMM) and myeloid (e.g., CFU-G, -M, or -GM) (FIG. 11B).

Gene editing at the HBB locus was then evaluated at 72 hours after electroporation of D10A nickase RNP co-delivered with 2 gRNAs (HBB-8 and HBB-15). Briefly, gDNA was isolated from electroporated CD34+ cells at 72 hours after electroporation, and PCR amplification of a ~607 bp fragment of the HBB locus (which captures both of the individual genomic locations that were targeted by gRNAs HBB-8 and HBB-15) was performed. After cleanup of the HBB PCR product with AMPURE beads, insertions/deletions (indels) at the targeted genomic location were evaluated by T7E1 assay and by DNA sequencing. For the CD34+ cells electroporated with 5 μg per million cells of D10A nickase RNP and HBB-specific gRNA pair, ~20% indels were detected by T7E1 analysis (Table 16). In contrast to adult CD34+ cells, a 2-hour incubation at 30° C. did not alter the level of gene editing as determined by either T7E1 analysis or DNA sequence analysis. In addition, doubling the D10A nickase RNP/gRNA concentration to 10 μg RNP per million cells nearly doubled the gene editing at the HBB locus to 57%, as determined by DNA sequencing analysis (Table 16, FIGS. 12A-12C). Stratification of DNA repair events through DNA sequencing analysis revealed that ~50-70% of the sequence reads contained small insertions, ~20-40% contained large deletions, and ~8% showed evidence of HBB/HBD gene conversion events in the targeted HBB genomic location (FIG. 12C).

TABLE 16

Summary of gene editing results in CB CD34+ cells 72 hours after co-delivery of D10A nickase RNP and HBB-specific gRNA pair.

| Total μg D10A RNP | μg D10A RNP/1E6 cells | μg HBB-8 gRNA | μg HBB-15 gRNA | Temperature of 2-hour recovery | % Gene Editing (indels by T7E1) | % Gene Editing (indels by sequencing) |
|---|---|---|---|---|---|---|
| 12.5 | 5 | 3.3 | 3.3 | 37° C. | 20 | 23 |
| 12.5 | 5 | 3.3 | 3.3 | 30° C. | 27 | 20 |
| 25 | 10 | 6.6 | 6.6 | 37° C. | 36 | 51 |

In contrast to adult CD34+ cells, CB CD34+ cells are fetal in origin and therefore the progeny of CB CD34+ cells express fetal hemoglobin (HbF) which contains γ-hemoglobin instead of β-hemoglobin. Given the lack of β-hemoglobin by CB eyrthroblasts, disruption of the HBB locus in this model system will not impact expression of hemoglobin protein. CB CD34+ cells are used as a model system for evaluation of gene editing in HSCs, since these umbilical cord blood derived CD34+ cells are more readily available for research use and reconstitute immune-deficient mouse xenografts more efficiently compared to adult CD34+ cells.

Figure 13C:
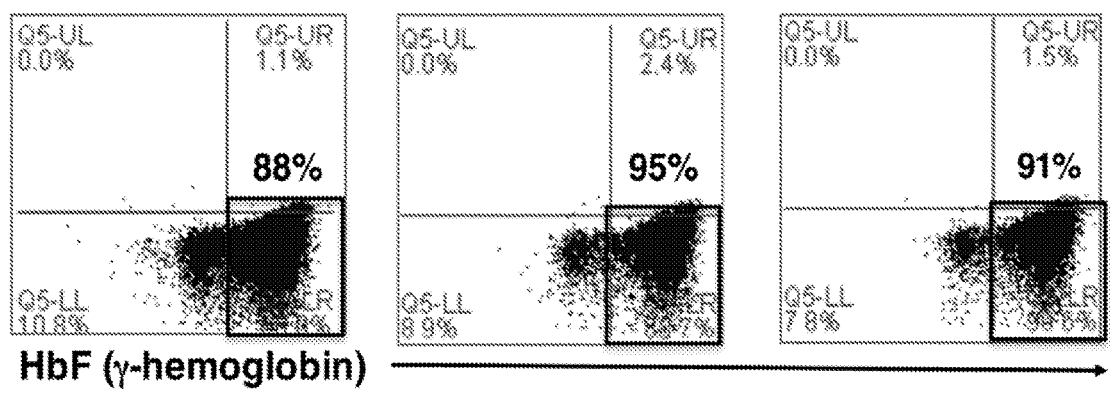

To determine whether gene edited cells retained their erythroid differentiation potential, the edited CD34+ cells were induced to differentiate into erythroblasts. Briefly, CD34+ cells were co-cultured with human plasma, holotransferrin, insulin, hydrocortisone, and cytokines (erythropoietin, SCF, IL3), for 20 days in which the latter 4 growth factors were added at different stages of differentiation to direct erythroid specification program. The cells were then evaluated by flow cytometry for the acquisition of erythroid phenotypic characteristics including: co-expression of the transferrin receptor (CD71) and Glycophorin A (CD235); expression of HbF, and enucleation (as indicated by the absence dsDNA detected by the dsDNA dye DRAQ5) and loss of CD45 expression. By day 18 of differentiation, the erythroblast progeny of edited CD34+ cells possessed this red blood cell phenotype (FIGS. 13A-13C). These data, along with the CFC data shown in FIGS. 11A-11B show that the gene editing does not negatively impact the differentiation potential of CD34+ cells.

In summary, the data in this Example indicate: 1) electroporation of fresh CB CD34+ HSCs with D10A nickase and paired capped/tailed gRNAs does not impact cell viability, or multipotency; and 2) contact between CB CD34+ HSCs and 10 μg D10A RNP (per million cells) supports >50% gene editing with HDR events (8% gene conversion events of total).

Example 11: Contact Between *S. pyogenes* Wild-Type Cas9 RNP or D10A Nickase RNP Complexed to gRNAs Targeting the HBB Genetic Locus Supports Up to 60% Gene Editing in Human Cord Blood Hematopoietic Stem Cells In this Example, umbilical cord blood (CB) CD34+ HSCs were contacted with *S. pyogenes* wild-type Cas9 RNP, N863A nickase RNP, or D10A nickase RNP complexed with 2 gRNAs targeting the HBB locus. The percentage of gene editing and type of editing event (e.g., HDR (e.g., gene conversion) or NHEJ) were evaluated to determine the optimal Cas9 activity (e.g., type of cut, e.g., double strand break from wild-type Cas9 or off-set nicks on opposite DNA strands by nickases) for gene editing in HSCs that would favor HDR (e.g., gene conversion) over NHEJ (e.g., ends of the DNA left exposed after the cut, e.g., blunt ends left by wild-type Cas9 cut, 5' overhang left by D10A nickase cut or 3' overhang left by N863A nickase cut). Other optimizations included: 1) removal of endotoxin from Cas9 protein preparation to reduce toxicity of Cas9 protein; 2) use of 10 μg RNP per million CD34+ cells to increase gene editing (shown to double gene editing in fresh CB CD34+ cells compared to 5 μg RNP, as indicated in Example 10); 3) testing of human CD34+ cells that were isolated from cord blood (CB), cryopreserved, and confirm that gene editing was not impacted by cryopreservation (compared to freshly isolated HSCs, described in Example 10); and 4) evaluate Cas9 RNP levels in CD34+ cells over time to understand Cas9 RNP stability in HSCs.

Human CD34+ HSCs cells were isolated from freshly obtained human umbilical cord blood by ficoll gradient density centrifugation followed by MACS sorting with mouse anti-human CD34+ immunomagnetic beads. CD34+ cells were cryopreserved, thawed at a later date, and plated into StemSpan Serum-Free Expansion Medium (SFEM™, StemCell Technologies) containing 100 ng/mL each of human stem cell factor (SCF) and flt-3 ligand (FL), 20 ng/mL each of thrombopoietin (TPO) and IL-6, and 10 μM PGE2 (Cayman Biochemicals; all other supplements were from PeproTech® unless otherwise indicated). Cells were grown for 3 days in a humidified incubator and 5% $CO_2$ 20% $O_2$. On day 3 (morning), media was replaced with fresh Stemspan-SFEM™ supplemented with human SCF, TPO, FL and PGE2. In the afternoon of day 3, 2.2 million CD34+ cells per sample were suspended in electroporation buffer.

The gRNAs were generated by in vitro transcription using a T7 polymerase. A 5' ARCA cap was added to the RNA simultaneous to transcription while a polyA tail was added after transcription to the 3' end of the RNA species by an *E. coli* polyA polymerase. After the gRNAs were in vitro transcribed and tailed, the quality and quantity of gRNAs were evaluated with the Bioanalyzer (Nanochip) to determine RNA concentration and by DSF assay performed as a measure of D10A Cas9 nickase RNP stability and as an indirect measure of gRNA quality.

In vitro transcribed capped and tailed guide gRNAs HBB-8 and HBB-15 were added at a 2:1 molar ratio (total gRNA:Cas9 protein) to 10 μg RNP per million cells. The RNPs tested include the following: wild-type (WT) Cas9, endotoxin-free WT Cas9, N863A nickase, D10A nickase. For each experimental sample, the D10A RNP/cell mixture was transferred to the electroporation cartridge, and the cells then electroporated with Program 2 (P2).

For all samples, the cells were collected from the cartridge and placed at 37° C. for 20 minutes (recovery period). For the CB CD34+ cells that were contacted with 10 μg D10A nickase RNP (per million cells), one sample was transferred to pre-warmed cytokine supplemented Stemspan-SFEM™ media and placed at 30° C. for 2 hours (cold shock recovery)

or placed directly into the same media at 37° C. For the cold shocked samples, the cells were transferred to the 37° C. incubator after the 2-hour incubation period at 30° C. At 24, 48, and 72 hours after electroporation, the CB CD34+ cells were counted by trypan blue exclusion (cell survival) and divided into 3 portions for the following analyses: a) flow cytometry analysis for assessment of viability by co-staining with 7-Aminoactinomycin-D (7-AAD) and allophycocyanin (APC)-conjugated Annexin-V antibody (ebioscience); b) flow cytometry analysis for maintenance of HSC phenotype (after co-staining with phycoerythrin (PE)-conjugated anti-human CD34 antibody (BD Biosciences) and APC-conjugated CD133 (Miltenyi Biotech; c) hematopoietic colony forming cell (CFC) analysis by plating 800 cells in semi-solid methylcellulose based Methocult medium (StemCell Technologies H4435) that supports differentiation of erythroid and myeloid blood cell colonies from HSCs and serves as a surrogate assay to evaluate HSC multipotency and differentiation potential ex vivo; d) genomic DNA analysis for detection of editing at the HBB locus; and e) Western blot analysis of protein to evaluate the stability of Cas9 RNP in CD34+ HSCs. gDNA was extracted from the HSCs at 48 and 72 hours after electroporation and HBB locus-specific PCR reactions were performed. The purified PCR products were analyzed for insertions/deletions (indels) in T7E1 assays and by DNA sequencing of individual clones (PCR product was transformed and subcloned into TOPO-vector, individual colonies picked, and plasmid DNA containing individual PCR products were sequenced).

Electroporated CB CD34+ cells maintained a stem cell phenotype (e.g., co-expression of CD34 and CD133, >90% CD34+CD133+) and as determined by flow cytometry analysis. The absolute number of viable CD34+ cells was maintained across most samples over a 72-hour culture period after electroporation (FIG. 14A). Gene edited CD34+ cells maintained ex vivo hematopoietic activity and multipotency as indicated by their ability to give rise to erythroid (e.g., CFU-E, or CFU-GEMM) and myeloid (e.g., CFU-G, -M, or -GM) (FIG. 14B).

Gene editing at the HBB locus was then evaluated at 72 hours after electroporation of WT Cas9, N863A, or D10A nickases co-delivered with 2 gRNAs (HBB-8 and HBB-15). Briefly, gDNA was isolated from electroporated CD34+ cells at 72 hours after electroporation, and PCR amplification of a ~607 bp fragment of the HBB locus (which captured both of the individual genomic locations that were targeted by gRNAs HBB-8 and HBB-15) was performed. After cleanup of the HBB PCR product with AMPURE beads, insertions/deletions (indels) at the targeted genomic location were evaluated by T7E1 assay and by DNA sequencing. For the CD34+ cells electroporated with WT Cas9 and endotoxin-free WT Cas9 the percentages of indels detected by T7E1 analysis at 72 hours was 59% and 51%, respectively (FIG. 15A), which correlated with the indels detected by DNA sequencing (Table 17). CD34+ cells electroporation with N863A nickase and HBB-specific gRNA pair, had only 1% indels detected by T7E1 analysis. CD34+ HSCs electroporated with D10A nickase with and without cold shock supported gene editing at percentages of 39% and 48% indels detected by T7E1 analysis, respectively. In order to confirm that this low level of editing observed in CD34+ HSCs contacted with N863A nickase, was not due to the lack of N863A RNP contacting the cells, western blot analysis was performed (FIG. 15B).

Cas9 protein was present in all electroporated samples (e.g., cells that received WT Cas9, D10A nickase, and N863A nickase). For these samples, Cas9 protein was detected at 24 and 48 hours after electroporation, suggesting that the lack of N863A activity in the CD34+ HSCs was not due to the lack of protein.

Gene editing in CD34+ HSCs that contacted WT Cas9, endotoxin-free Cas9, and D10A nickase was 54-60%, based on DNA sequencing analysis (Table 17, FIG. 16A). Stratification of DNA repair events through DNA sequencing analysis revealed that >90% of the gene editing events were deletions in CD34+ HSCs that contacted WT Cas9 and endotoxin-free WT Cas9 (insertions or combination of insertion and deletion comprised the remaining 3-6% of editing events) (FIG. 16A). In contrast, gDNA from CD34+ HSCs that contacted D10A nickases had 3% HDR (e.g., gene conversion), up to 75% insertions, and up to 22% deletions (FIG. 16B).

In summary, the data in this Example indicate: 1) endotoxin removal does not negatively impact Cas9 functionality or CD34+ HSC cell viability, or multipotency; 2) use of 10 µg D10A RNP supports 60% gene editing in CD34+ HSCs with HDR events (e.g., gene conversion); and 3) after contacting CD34+ HSCs, WT Cas9 and nickase RNPs are detected for up to 48 hours, but is not detectable thereafter.

TABLE 17

Summary of gene editing results in CB CD34+ cells 72 hours after co-delivery of wild-type Cas9, N863A nickase, D10A nickase RNP and HBB-specific gRNA pair.

| Cas9 | Total µg RNP/1E6 cells | Temperature of 2-hour recovery | % Gene Editing (indels by T7E1) | % Gene Editing (indels by sequencing) |
|---|---|---|---|---|
| WT | 10 | 37° C. | 59 | 56 |
| Endo-Free WT | 10 | 37° C. | 51 | 60 |
| N863A | 10 | 37° C. | 1 | ND |
| D10A | 10 | 37° C. | 39 | 60 |
| D10A | 10 | 30° C. | 48 | 54 |

Example 12: Gene Editing at the HBB Locus in Human CD34+ Hematopoietic Stem/Progenitor Cells after Delivery of Cas9 Protein Complexed to In Vitro Transcribed Modified gRNAs Engineered with a polyA Tail Encoded in a DNA Template Encoding Poly-A Tail in the DNA Template that Encodes the gRNA.

Adult human hematopoietic stem/progenitor cells (HSCs) electroporated with Cas9 and gRNAs that were unmodified (e.g., absence of ARCA cap and polyA tail) had reduced survival, viability, and hematopoietic potential and low percentages of gene editing compared to adult human HSCs that were electroporated with in vitro transcribed capped and tailed gRNAs (FIGS. 5A-C and FIGS. 6A-G). After in vitro transcription of the ARCA capped gRNA (mMessage Machine™ T7 Ultra Transcription Kit, Ambion), the gRNA was incubated with *E. coli* PolyA Polymerase (E-PAP), and the capped/tailed gRNA was then cleaned up using the MegaClear™ Kit (Ambion). The polyA tail added by E-PAP tailing reaction varied between experiments. In order to standardize the length of the polyA tail at the 3' end of the gRNA, the 3' antisense primers encoding the gRNA tracr were altered to contain specific length polyT sequences, which results in a DNA template for the specific length polyA tail. The length of polyA tails generated by the antisense primers were: 10, 20, 50, and 100. The DNA templates encoding HBB specific gRNAs (HBB-8 (SEQ ID NO:388) and HBB-15 (SEQ ID NO:387)) were generated by PCR and in vitro transcribed with the mMessage Machine™ T7 Ultra Transcription Kit according to the manufacturer's protocol with one modification: the E-PAP tailing reaction was omitted since the polyA tail was encoded in the DNA template.

The PCR products generated from the reactions for in vitro transcription DNA templates for the HBB gRNAs with 10, 20, and 50 length polyA tails yielded clean PCR products (FIG. 17A). In contrast, the DNA template for the HBB gRNAs with 100 length polyA tails yielded several products of different sizes. Therefore, in vitro transcription was only performed with the HBB gRNA DNA templates with the 10A, 20A, and 50A length polyA tails encoded in the templates. The purified PCR products were in vitro transcribed with the mMessage Machine™ T7 Ultra Transcription Kit excluding the E-PAP tailing reaction, since the tails were encoded in the DNA template for each gRNA. Bioanalyzer results of the HBB-8 (SEQ ID NO:388) gRNA products indicated gRNAs were generated of the appropriate size products consistent with the DNA templates (FIG. 17B) and the polyA tail lengths when encoded in the DNA templates yielded gRNA products of defined size compared to gRNAs generated with a polyA tail generated enzymatically by incubation with E-PAP.

In this example, human umbilical cord blood CD34+ HSCs were then electroporated with D10A Cas9 RNP complexed with HBB-8 (SEQ ID NO:388) and HBB-15 (SEQ ID NO:387) gRNAs with polyA tails of defined lengths (e.g., 10A, 20A, 50A). Viability analysis by flow cytometry (AnnexinV− 7AAD−) indicated no difference in the percentage of live CD34+ cells 72 hours after electroporation with D10A Cas9 RNP complexed with gRNAs with engineered polyA tails of defined lengths compared to cells that were electroporated with D10A Cas9 RNP and gRNAs with polyA tails added enzymatically with E-PAP (FIGS. 18A-18B). Gene editing for cells contacted with D10A RNP and gRNA pair (HBB-8 (SEQ ID NO:388) and HBB-15 (SEQ ID NO:387)) containing 10A or 20A length polyA tail was ~51% based on T7E1 endonuclease assay (FIG. 18C). DNA sequence analysis by Sanger DNA sequencing of the HBB locus confirmed 61% and 59% gene editing was achieved in human CD34+ cells electroporated with Cas9 RNP containing gRNAs that were modified to have a 10A or 20A length tail, respectively (FIG. 18C). These findings indicate that D10A Cas9 protein complexed to gRNAs modified to include a 5'cap and 3' polyA tail of specific length supported gene editing in primary human hematopoietic stem/progenitor cells.

Example 13: CRISPR/Cas9 RNP Supports Highly Efficient Gene Editing at the HBB Locus in Human Adult and Cord Blood CD34+ Hematopoietic Stem/Progenitor Cells from 15 Different Stem Cell Donors To determine the reproducibility of Cas9 RNP mediated gene editing in hematopoietic stem/progenitor cells, cryopreserved CD34+ cells obtained from 15 different patient donors (i.e., 12 cord blood CD34+ cell donors and 3 adult mobilized peripheral blood CD34+ cell donors) were thawed into StemSpan SFEM medium with human cytokines (e.g., SCF, TPO, FL, and IL6), 10 µMPGE2, with or without 1 µM SR1 for 48-72 hours and then electroporated with S. pyogenes Cas9 RNP (D10A nickase or WT) pre-complexed to gRNA targeting HBB (e.g., D10A nickase pre-complexed with HBB-8 (SEQ ID NO: 388) or HBB-15 (SEQ ID NO: 387) gRNAs and the 2 pre-complexed RNPs mixed and added to the CD34+ cells) or AAVS1 (WT Cas9 with sgRNA AAVS1-1 (SEQ ID NO: 494)). For all experiments described in this example, gRNAs were in vitro transcribed from a PCR template that encodes a modified T7 promoter, gRNA, and a polyA tail (20A) 3' to the gRNA. An ARCA cap is added to the 5' end of the gRNA in the in vitro transcriptions process, thus, all gRNAs tested in these experiments are modified gRNAs (i.e., modified at 5' end with ARCA cap and 3' end with polyA tail). For the 15 donor CD34+ cell populations tested in separate experiments, 5 experiments were conducted to test gene editing with WT Cas9 RNP delivery (e.g., sgRNA, either AAVS1-1 or HBB-8) and 10 experiments were conducted to test editing with D10A nickase and 2 gRNAs (i.e., HBB-8 and HBB-15).

Figure 19A:
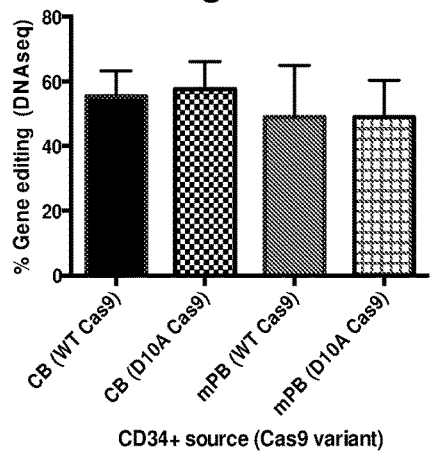
Figure 19B:
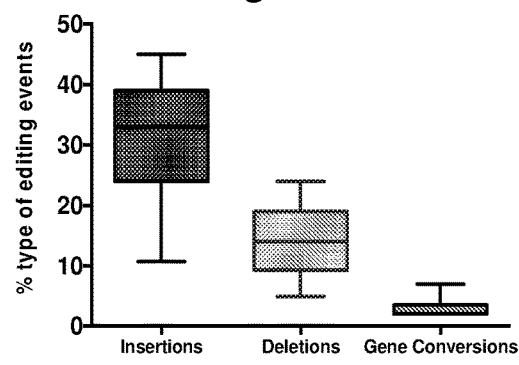
Figure 19C:
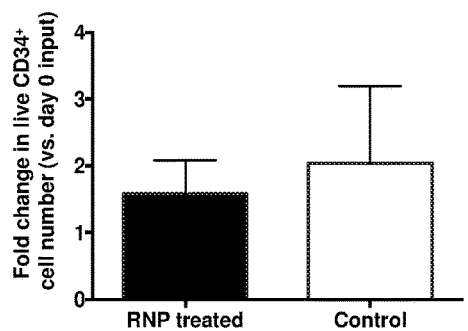
Figure 19D:
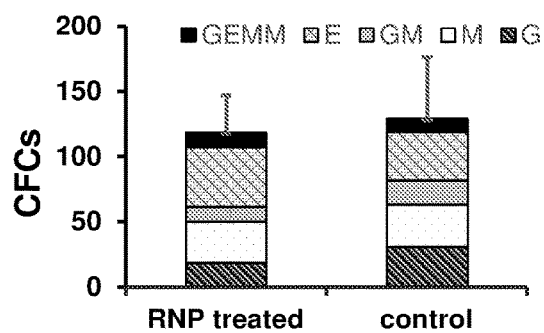
Figure 19E:
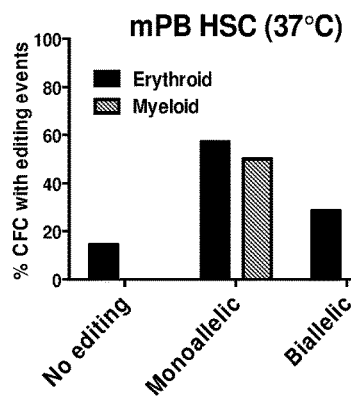
Figure 19E:
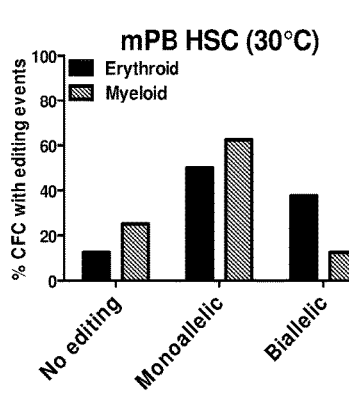
Figure 19F:
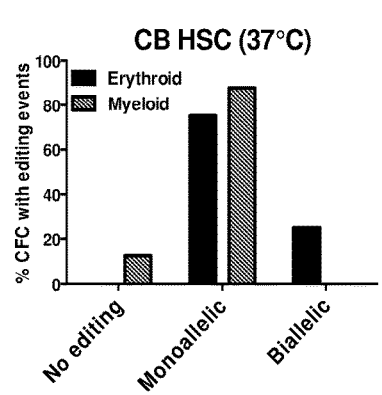

Composite analysis across the 15 separate experiments and donors showed 57% editing (mean±stdev: 56.9±8%) in cord blood CD34+ cells (e.g., 56% with WT Cas9 RNP+ sgRNA, 58% D10A RNP+2 gRNAs) and 52% editing (mean 52.3±10%) in adult mobilized peripheral blood CD34+ cells (FIG. 19A). Gene editing was determined by DNA sequencing analysis of genomic DNA that was extracted from CD34+ cells electroporated with Cas9 RNP. In depth analysis of the subtypes of editing events that occurred after CD34+ cells contacted Cas9 D10A RNP and 2 gRNAs (i.e., HBB-8 and HBB-15) showed that a mean of 31±11% of the events were insertions (range 11-41%), 14±6% were small deletions (range 5-17%), and 3±2% were repaired through gene conversion or HDR (range 2-7%) (FIG. 19B). Given that human CD34+ cells are highly sensitive to perturbation by electroporation or by contact with foreign proteins and nucleic acid, the viability of HSCs after contacting Cas9 RNP was evaluated by flow cytometry analysis for detection of viable (7-AAD− AnnexinV−) CD34+ cells. The percentage of viable CD34+ cells was measured by flow cytometry analysis and then the percentage of live CD34+ cells was multiplied by the total cell number which was determined by trypan blue exclusion after electroporation and then divided by the input cell number in order to calculate the fold change in the number of untreated and RNP electroporated (treated) CD34+ cells from the same donor. The mean and standard deviation of RNP treated and control (i.e., untreated) cells for multiple donors (n=10) is shown (FIG. 19C). For each stem cell donor, the fold-change in the number of untreated control and RNP treated CD34+ cells from each donor was compared in a paired 2-tailed t-test to determine if RNP contact altered cell viability. Statistical analysis of these data showed no statistically significant difference between RNP treated and controlled CD34+ cells (RNP treated vs. control mean fold change in the number of cells: 1.5 vs. 2.0; P-value summary not significant, P-value=0.1217). To determine whether RNP treatment and gene editing effected HSC multipotency and differentiation potential, the mean colony forming cell potential (CFCs) and individual colony subtypes were scored and then analyzed in paired t-test (n=10). There were no significant differences detected in the total CFCs or the subsets of CFCs between RNP treated and control CD34+ cells (FIG. 19D). The level of disruption in individual CD34+ cells was then determined by DNA sequencing analysis of CFCs (each CFC is differentiated from a single CD34+ cells, thereby allowing for single cell analysis of HSCs by assaying the clonal progeny of the plated cells). DNA sequencing analysis of the HBB locus PCR products showed higher levels of gene editing detected the erythroid and myeloid progeny of the CD34+(~80-90% edited CFCs) from differentiated from mPB HSCs and CB HSCs (FIG. 19E). Monoallelic and biallelic editing of the locus was detected. A 2-hour cold shock after electroporation and before plating cells into colony assays altered the distribution of monoallelic and biallelic editing detected in the myeloid and erythroid CFC progeny of the edited CD34+ cells (FIGS. 19E and 19F).

Example 14: Cas9 RNP Gene Edited Human CD34+ Cells Retain Long-Term Engraftment and Hematopoietic Reconstitution Potential In Vivo In order to confirm that Cas9 RNP contact and gene editing do not negatively impact HSC engraftment potential, in vivo human HSC/mouse xenograft transplantation studies were initiated, the schema for which is shown in FIG. 20A. In this example, fresh (i.e., not cryopreserved) human cord blood CD34+ hematopoietic stem cells were plated into StemSpan SFEM containing human cytokines (e.g., SCF, TPO, FL and IL6) and PGE2 and cultured for 48 hours for prestimulation. The human CD34+ cells were divided into two equal fractions and ½ of the cells (i.e., 1 fraction) was electroporated with D10A nickase Cas9 RNP (i.e., Cas9 protein complexed to sgRNAs HBB-8 (SEQ ID NO:388) and HBB-15 (SEQ ID NO:387), cultured for an additional 48 hours which brought total time ex vivo to 4 days. The second fraction of CD34+ cells were cultured without being treated with Cas9 (untreated control). One day (approximately 24 hours) before human CD34+ cell infusion, immunodeficient mice (i.e., NOD.Cg-Prkdcscid Il2rgtm1Wjl/SzJ, NOD-scid IL2Rgamma$^{null}$, NSG) were treated with 20 mg/kg Busulfan (i.p.). The cells were intravenously infused into the busulfan treated mice: Group 1 (control) received untreated human CD34+ cells (n=5 mice), with a "progeny of" cell dose of 260,000 cells/mouse (actual Day 0 cell dose for control mice: 320,000/cells mouse). A "progeny of" cell dose refers to the number of cells as calculated after 2-day prestimulation (Day −2 cell dose) but before the time of exposure to either control culture conditions (control group) or electroporation with Cas9 RNP (RNP treated). Group 2 mice (RNP treated, n=7 mice) were each transplanted with a "progeny of" cell dose of 260,000 cells/mouse (actual Day 0 cell dose for control mice: 240,000 cells/mouse). Blood draws were taken every 2 weeks and the blood assayed for the detection of gene editing events and for detection of human cell engraftment as indicated by the presence of human CD45+ blood cells in the mouse peripheral blood samples. Twelve weeks after CD34+ cell transplantation, ½ mice from each group were euthanized and the bone marrow, spleen, and peripheral blood were collected for analysis. The remaining live mice continued on study for an additional 1-4 months for long-term follow-up of CD34+ cell engraftment and secondary CD34+ cell transplantation. In this particular study, assessment of gene editing in the cells that were contacted with D10A RNP (HBB-8 (SEQ ID NO:388) and HBB-15 (SEQ ID NO:387)), indicated 30-35% gene editing as determined by DNA sequencing and T7E1 assay analysis (FIG. 20B). Analysis of the types of editing events detected the following subtypes of genetic changes to the HBB locus: 14% deletion, 14% insertion, 2% gene conversion (HDR). CFC analysis of the erythroid and myeloid progeny of the RNP treated and control (untreated) CD34+ cells showed a slight reduction of short-term colony forming potential, but this difference was not statistically significant (FIG. 20C). DNA sequencing analysis of individual clones picked from the CFC assays showed up to 40% and 60% editing at 1 allele (monoallelic editing) in BFU-E/GEMM and CFU-GM/M, respectively, and biallelic editing was detected in BFU-E/GEMM at a frequency of 12.5% (BFU-E/GEMM total editing: 52.5%, CFU-GM/M total editing: 60%) (FIG. 20C). To evaluate the kinetics of hematopoietic reconstitution, blood samples were collected between 6-12 weeks. Blood samples were analyzed for gene editing events by T7E1 analysis of PCR products (generated with human HBB specific PCR primers) from gDNA extracted from mouse peripheral blood samples (FIG. 20D). Gene editing was detected in the blood of mice transplanted with RNP treated human CD34+ cells at multiple time points relative to the time of human cell transplantation. Human CD45+ blood cells were also detected by flow cytometry at multiple time points in the blood of mice transplanted with either RNP treated human CD34+ cells or mice transplanted with untreated control human CD34+ cells (FIG. 20D). Peripheral blood samples were also analyzed by flow cytometry for the detection of human blood cells (Human CD45+) by flow cytometry as a measure of human cell engraftment in the mouse bone marrow. Blood samples were co-stained with a human CD45 specific antibody and a mouse-specific CD45 antibody, so as to clearly distinguish between the mouse and human CD45+ cells. Blood samples were also stained with human antibodies that bind to human lymphoid cells (e.g., CD20, B cells and CD3 T cells), myeloid cells (e.g., CD14 and CD33), and erythroid progenitors (e.g., CD71). Human CD45+ cells were detected. Lymphoid (CD20 B cells), myeloid cells, and erythroid progenitors could be distinguished within the human CD45+ cell gate in the mouse blood samples (FIG. 20D). Analysis of peripheral blood 6-12 weeks after transplantation showed up to 33.6% human CD45+ cells were detected in the blood of mice transplanted with RNP treated CD34+ cells and the level of human CD45+ cells detected in the blood samples increased over time (engraftment at 12 weeks after transplantation: mean of control group: 11% hCD45+ of RNP treated group: 18% hCD45+ cells; FIG. 20E). Importantly, statistical analysis of these data indicated no significant difference in the level of engraftment between RNP treated CD34+ cells and untreated control CD34+ cells (unpaired t-test P-value=0.2376). Subset analysis of cells in the human CD45+ gate showed no significant difference in the human blood cell lineage distribution between mice transplanted with RNP treated CD34+ cells and untreated control CD34+ cells (unpaired t-tests). Consistent with data reported in literature, on average ~80% RNP treated: 76%, control 82%) of the cells in the human CD45+ gate was CD20+ B cells, ~3% were CD3+ T cells, and the remained 15% were erythroid (untreated control: 6% and RNP treated: 11%) and myeloid (untreated control: 9% and RNP treated: 4%) (FIG. 20E).

At 12 weeks after transplantation, the hematopoietic organs (bone marrow and spleen) were collected from ½ of the mice from each cohort, dissociated to single cell suspension and analyzed in CFC assays, flow cytometry analysis, and for gene editing as determined by T7E1 assay and DNA sequencing. Flow cytometry analysis of the marrow and spleen indicated that there was no significant difference in engraftment between mice transplanted with RNP treated cells and mice transplanted with control cells (FIG. 21A). The mean engraftment of human CD45+ cells in the mouse marrow was 19% and 21% for RNP treated cell recipients and control cell recipients, respectively. Within the human CD45+ cell fraction in the marrow, 13% of the CD45+ cells were also CD34+ (HSCs) for both groups. In the spleen, an average of 23% and 26% human CD45+ cells were detected in recipients of RNP treated and untreated control CD34+ cells. To evaluate gene editing and CFC potential in human CD45+ cell fractions, the human cells were isolated from the marrow and spleen with a immunomagnetic cell isolation kit (EasySep Mouse/human Chimera isolation kit). For the marrow, cells were sorted to >98% purity (FIG. 21B), placed in CFC assays, and gDNA extracted from the sorted cells for analysis of gene editing. The CD34$^+$ cell content was also maintained after sorting of the human cell fraction. T7E1 analysis of human gDNA revealed up to 20% gene editing in the marrow of treated mice. Gene editing was also detected in the spleen (sorted to 70% human cell purity) and peripheral blood samples (unsorted), at an average of 5% indels (FIG. 21C).

Together, these data showed that Cas9 mediated gene edited HSCs retain long-term engraftment and hematopoietic reconstitution potential and that RNP treatment did not alter hematopoietic reconstitution or differentiation properties in comparison to naïve untreated donor matched control CD34$^+$ cells. Further, these data indicated that gene edited cells persist in vivo after transplantation.

Example 15: Long-Term Engraftment of Gene-Edited Human CB CD34$^+$ Cells

To evaluate long-term engraftment (for the experiment depicted in FIGS. 20-22) 4 months after transplantation, the remainder of mice on study for experiment 1 (EXPT 1) were euthanized and the hematopoietic organs collected for analysis of engraftment of gene-edited human cells. In addition, a second experiment (EXPT 2, FIG. 23) was set up in which CB CD34$^+$ cells from a different donor were either left untreated or electroporated with D10A Cas9 RNP with 2 modified (capped and tailed) gRNAs (HBB-8 and HBB-15) after pretreatment with StemRegenin-1 (SR1) which has been used for CB CD34$^+$ cell expansion, but here was used to prevent cell death after acute exposure to Cas9 protein and gRNAs (i.e., bacterial protein and foreign nucleic acid). The differences in experimental design between two experiments experiment 1 (EXPT 1) and experiment 2 (EXPT2) are represented in Table 18, below.

TABLE 18

| Parameter | EXPT 1 | EXPT 2 |
| --- | --- | --- |
| Busulfan (mg/kg) | 20 | 25 |
| Pre-stimulation (culture conditions) | SCF, TPO, FL, IL6, PGE2 | SCF, TPO, FL, IL6, PGE2, 1 µM SR1 |
| CD34$^+$ cells/mouse | 260,000 | 570,000 |
| Control group (n) | 5 | 6 |
| RNP treated group (n) | 7 | 7 |
| Gene editing in infusion product (DNAseq) | 30% | 50% |

For EXPT 1 transplant recipients were euthanized 4 months after transplantation and their blood (FIG. 22A), spleen (FIG. 22B), and bone marrow (FIG. 22C) collected for analysis of total human CD45$^+$ cell content, for human lymphoid, myeloid, and CD34$^+$ HSC content, and for analysis of gene editing in human cell fractions isolated from hematopoietic organs, as determined by DNA sequencing analysis (FIGS. 22E-I, right panels).

Flow cytometry analysis of the cells from transplant recipients from EXPT 1 indicated that ~20% human CD45$^+$ cell engraftment was detected in the blood, spleen and marrow of the recipients of RNP treated and untreated control human CB CD34$^+$ cells from the same donor. No significant difference (paired t-test, P<0.05) within the human CD45$^+$ cell gates in the human lineage distributions in the organs of recipients of RNP treated cells vs. control untreated cells was observed. In addition, 15% human CD34$^+$ cells were detected in the marrow of both cohorts, with no difference in long-term engraftment between groups. For EXPT 1, DNA sequencing analysis of sorted human cells isolated from the spleen and bone marrow showed ~10% gene editing in the human cell fractions in the cells recovered from organs of mice transplanted with RNP treated but not control untreated CB CD34$^+$ cells. Analysis for the subtypes of events detected in the spleen and bone marrow human cells recovered from mice transplanted with RNP treated CD34$^+$ cells indicated that both insertions and deletions were detected in the engrafted cells, and the level of gene editing detected in those cells was similar to the level of gene editing detected ex vivo in the infusion product before transplantation (FIGS. 22H and 22I).

In EXPT 2, the frequency of detected gene editing events before infusion was 50%. Before cell transplantation, mice were conditioned with busulfan (25 mg/kg). Approximately 24 hours after conditioning, mice were intravenously infused with RNP treated or untreated control human CD34$^+$ cells (570,000 CD34$^+$ cells/mouse, a dose that is >double the 260,000 cell dose administered per animal in EXPT 1).

With respect to EXPT 2, ~80% human CD45$^+$ cell engraftment was detected in the blood, 70% in the spleen and marrow of the recipients of RNP treated and and untreated control human CB CD34$^+$ cells from the same donor (FIGS. 23A, 23B, 23C). No significant difference (paired t-test, P<0.05) within the human CD45$^+$ cell gates in the human lineage distributions in the organs of recipients of RNP treated cells vs. control untreated cells was observed. In addition, 22% human CD34$^+$ cells were detected in the marrow and spleen of both cohorts, with no difference in long-term engraftment between groups. For EXPT 2, the CD3$^+$ lymphoid reconstitution of peripheral blood and the CD235$^+$ erythroid reconstitution of the marrow was higher than the respective reconstitution observed in EXPT 1.

For EXPT 2, DNA sequencing analysis of HBB PCR product generated from gDNA extracted from the enriched human cells recovered from the mouse hematopoietic organs indicated that ~50% gene editing was detected in the peripheral blood, spleen, and bone marrow 4 months after RNP-treated CB CD34$^+$ cell transplantation (FIGS. 23E, 23F, 23G, 23H, 23I; middle panels).

Analysis for the total editing in the human cell fractions enriched from the spleens and marrow of transplant recipients and the subtypes of events detected indicated that both insertions and deletions were detected in the engrafted cells, and that the level of gene editing detected in those cells was similar to the level of gene editing detected ex vivo in the infusion product before transplantation. To compare the level of gene editing across myeloid and erythroid progeny and long-term engrafted human HSCs, human CD34$^+$ hematopoietic progenitors, human CD235$^+$ erythroid progenitors, and CD33$^+$ myeloid cells were serially sorted from the human cell fraction enriched from the bone marrow (isolated human cells using the StemCell Technologies human mouse chimera kit for depletion of mouse cells, followed by serial positive selection for human CD34$^+$, CD235$^+$ and CD33$^+$ subsets using lineage specific enrichment with the Miltenyi MACS system. Flow cytometry analysis of the human cell fraction indicated substantial repopulation with human CD235$^+$ erythroid and human CD34$^+$ HSCs (FIG. 24A). Analysis of gene editing in these sorted cell fractions indicated that the level of gene editing detected in the bulk human cell population was maintained and consistent across the sorted human subsets (FIG. 24B).

Together, these data showed that Cas9-mediated gene edited HSCs retain long-term engraftment and hematopoietic reconstitution potential and that RNP treatment did not alter hematopoietic reconstitution or differentiation properties in comparison to naïve untreated donor matched control CD34+ cells. Further, these data indicated that gene edited cells persist in vivo after transplantation.

Example 16: Short-Term Engraftment of Gene-Edited Human Adult mPB CD34+ Cells

To evaluate the engraftment potential of adult HSCs after Cas9-mediated gene editing, mPB CD34+ cells were electroporated with D10A Cas9 RNP with modified (capped/tailed) HBB-8 and HBB-15 gRNAs. Total gene editing frequency in the mPB CD34+ cells was ~22% in the pre-infusion product (FIG. 25A). Mice conditioned with 25 mg/kg busulfan (~24 hours before transplantation) were intravenously infused with donor matched RNP treated or untreated control mPB CD34+ cells (~1 million cells/mouse, n=3 mice/group). Ten weeks after transplantation, human CD45+ cell reconstitution was evaluated in the peripheral blood. For both cohorts, ~10% CD45+ cells were detected in the peripheral blood, indicating no difference in short term engraftment of RNP treated and untreated control adult CD34+ cells (FIG. 25B-25D). Within the human CD45+ cell gate, both lymphoid (CD20+ B cells) and myeloid (CD33+ granulocytes) were detected with no difference in lineage contribution to in vivo hematopoiesis between the 2 cohorts. These data show that Cas9-mediated gene edited adult HSCs retain engraftment and hematopoietic reconstitution potential and that RNP treatment did not alter hematopoietic reconstitution or differentiation properties in comparison to naïve untreated donor matched control CD34 cells.

Example 17: Gene Modification Through Homology Directed Repair Mechanism in Human CD34+ Hematopoietic Stem/Progenitor Cells after Co-Delivery of D10A RNP with 2 gRNAs and ssODN Donor Template To evaluate homology directed repair (HDR) in human HSCs, CB CD34+ cells were electroporated with D10A RNP plus HBB-8 and HBB-15 modified gRNAs (capped/tailed) with a single strand oligonucleotide donor repair template (ssODN). The repair template has high homology to the HBB target site with a few base changes (SNPs) that allow for identification of a gene modification event by DNA sequencing. Given that foreign nucleic acid, especially DNA, has been shown to induce an innate immune response in human CD34+ cells, we evaluated a range of ssODN doses (in pmoles per 200,000 cells) and compared the toxicity of ssODN co-delivery with D10A RNP plus gRNAs and either no ssODN, ssODN donor template without 5' and 3'-end modifications (non-modified ssODN, [NM]), or ssODN donor template with phosphorothioate-modified 5' and 3' ends ("Phx" or "PhTx"). Titrating down the amount of ssODN delivered to the CD34+ cells did not reduce the gene editing detected by either T7E1 endonuclease analysis or by DNA sequencing analysis (FIG. 26A, 26C). However, exposure to lower quantities of ssODN improved cell viability, as indicated by fold change in the number of viable CD34+ cells over several days after electroporation (FIG. 26B). Inclusion of the '5 and 3' phosphorothioate moieties on the ssODN donor template increased the level of gene modification and total HDR (i.e., gene modification and gene conversion) (FIG. 26C, 26D). When electroporated with 100 pmoles 5' and 3' phosphorothioate-modified ssODN donor template plus D10A RNP and 2 modified gRNAs, HDR increased to ~12%, as compared to 7% HDR observed when cells were electroporated with the 100 pmoles 5' and 3' non-modified ssODN donor template plus D10A RNP and 2 modified gRNAs.

To determine whether the quantity of ssODN could be further reduced, a second experiment was set up with another CB CD34+ cell donor, in which 0, 50, 75, and 100 pmoles ssODN (per 200,000 cells) was co-delivered with D10A Cas9 RNP plus HBB-8 and HBB-15 modified gRNAs. Gene editing as determined by T7E1 analysis and DNA sequencing revealed no difference in editing between the cells treated with 50, 75, or 100 pmoles ssODN (FIG. 27A). Importantly, there was no difference in viability among any of the treated cell populations (FIG. 27B). HDR as determined by DNA sequencing analysis revealed no difference in gene modification (i.e., repair of the DNA lesion with the ssODN donor template) between the cells that received either 50, 75, or 100 pmoles of ssODN donor template (FIG. 27C, 27D). However, total HDR (i.e., the sum of gene conversion events and gene modification events) was highest in cells treated with 50 pmoles ssODN. In addition, ssODN did not substantially reduce hematopoietic colony forming-potential as compared to cells electroporated with D10A RNP and gRNAs in the absence of ssODN donor template (FIG. 27E). To further validate these results, the experiment was repeated in 2 additional CB CD34+ cell donors and one adult mPB CD34+ cell donor, using 100 pmoles ssODN donor template co-delivered with D10A RNP and HBB-8/HBB-15 modified gRNAs. HDR was detected in all treated samples by DNA sequencing analysis, with some donor to donor variability (FIG. 28). Together, these results indicated that co-delivery of D10A Cas9 RNP plus 2 modified gRNAs and 5' and 3' phosphorothioate-modified ssODN donor template support HDR in human primary CD34+ HSCs.

Example 18: Pretreatment of Human CD34+ Cells with Small Molecule Compounds Before Treatment with Cas9 RNP Improves Cell Survival, Viability and Gene Editing Given that human CD34+ cells are sensitive to perturbations in their cellular milieu, particularly due to exposure to foreign protein and nucleic acids that may activate a cellular innate immune response through the toll-like receptor (TLR) pathway, and thus induce programmed cell death (e.g., by apoptosis), growth arrest or autophagy, CD34+ cells were pre-treated (18 hours) with the oxidized phospholipid 1-palmitoyl-2-arachidonyl-sn-glycero-3-phosphorylcholine (OxPAPC), a small molecule compound known to inhibit TLR pathways (e.g., TLR2 and TLR4 pathways are activated by bacterial components and LPS, respectively); bafilomycin, a compound which prevents cell death by apoptosis or autophagy during cell stress; rapamycin (an mTOR inhibitor which improves lentiviral gene therapy in HSCs (see, e.g., Wang et al. (2014) *Blood* 124(6):913-23 2014; the proteasome inhibitor MG132 (see, e.g., Santoni DiSio et al. (2006) *Blood* 107(11): 4257-4265), SR-1 and UM171, or UM171 alone, molecules previously shown to expand and maintain viable human CB CD34+ cells ex vivo (see, e.g., Fares et al. (2014) *Science* 345(6203): 1509-1512), or a combination of SR-1 and UM171. CB CD34+ cells were pre-treated with each of these stem cell viability enhancers (Table 19) for 18 hours prior to electroporation with D10A Cas9 RNP, HBB-8 and HBB-15 modified gRNAs, and 5' and 3' phosphorothioate-modified ssODN donor template. After electroporation, cells were replated into HSC medium containing these stem cell viability enhancers and cultured for an additional 3 days.

Although total gene editing and HDR, as determined by DNA sequencing analysis, was highest for the cells that were not pretreated with a stem cell viability enhancer (Table 19, 71% and 12%, respectively), the viability of these cells was only 42%. In contrast, cells pretreated with UM171, a combination UM171 and SR1, rapamycin, or OxPAPC, had increased viability compared to the electroporated cells that received no pre-treatment. A 20% improvement in viability, increased total editing (78%), and maintained HDR (8%) was observed in cells treated with the TLR inhibitor OxPAPC. These data indicate that pretreatment with stem cell viability enhancers can improve editing of and viability in HSCs.

TABLE 19

| Stem Cell Viability Enhancer | Concentration | % Viability of CD34+ stem cells | % Total Gene Editing | % NHEJ | % HDR |
|---|---|---|---|---|---|
| — | — | 42 | 73 | 61 | 12 |
| UM171 | 35 nM | 60 | 79 | 79 | 0 |
| UM171/SR-1 | 35/40 nM | 37 | 69 | 61 | 8 |
| Rapamycin (sirolimus) | 5 nM | 52 | 53 | 46 | 7 |
| OxPAPC | 30 µg/mL | 64 | 78 | 71 | 7 |
| Bafilomycin A1 | 1 µM | 23 | 18 | 18 | 0 |
| MG132 | 0.5 µM | 19 | 0 | 0 | 0 |

Example 19: Addition of a 20A Poly(A) Tail to gRNA Improves Gene Editing of CRISPR/Cas9 Protein in Human CD34+ Cells without Reducing Cell Viability of Hematopoietic Activity To determine whether an optimal, minimal, and specific 3' end gRNA modification could by defined, several different modifications were engineered into the PCR DNA template for in vitro transcription of the gRNAs in order to generate gRNAs having different 3' ends. For all gRNAs differentially modified at the 3' end, each gRNA was in vitro transcribed and modified at the 5' end with an ARCA cap which was added during the in vitro transcription process. The HBB genetic locus was targeted for gene modification in which the gRNA HBB-8 was modified to have the following 3' end modifications: a poly(A) tail of varying lengths (e.g., 2A, 5A, 10A, 15A, 20A, and 25A), a poly(T) tail of varying lengths (e.g., 10T, 20T), or a poly(G) tail of varying lengths (e.g., 10G, 20G). The presence of the 3' end gRNA modifications was validated by gel electrophoresis and using a Bioanalyzer (Nanochip®). After validation, the gRNAs were subjected to QC analysis in DSF shift assays, in which wild-type Cas9 protein was complexed with different molar ratios of gRNA to determine the optimal molar ratio of Cas9 protein:gRNA (e.g., 1:1, 1:1.5, 1:2, etc.) at which the Cas9 protein was fully occupied or complexed with gRNA. Human CB CD34+ cells were then electroporated using an Amaxa Nucleofector with Cas9 RNP in which the gRNAs complexed to Cas9 protein were differentially-modified on the 3' end. Three days after electroporation, the CB CD34+ cells were analyzed for fold change in the number of cells to determine cell viability, HSC functionality by plating the cells into CFC analysis of colony forming potential, and the gDNA extracted from samples for assessment of gene editing at the target locus by T7E1 assay and DNA sequencing analysis of the human HBB locus specific PCR products. In this experiment, gRNAs with poly(A) tail modifications supported the highest frequency of gene editing, as determined both by T7E1 assay analysis (FIG. 29A) and DNA sequencing analysis (FIG. 29B). DNA sequencing analysis indicated that the optimal poly(A) tail length was 20As (FIGS. 29A and 29B). CFC analysis of colony forming potential of the RNP treated cells indicated that all edited cell populations maintained colony forming potential, regardless of the level of gene editing (FIG. 29C).

Example 20: Use of gRNAs Having 5'- and 3'-End Modifications Using a CRISPR/Cas9 Dual Nickase Strategy Increased Gene Editing in HSCs that Maintain Viability and Hematopoietic Activity Ex Vivo To determine whether both 5'- and 3'-end modifications are required to achieve both efficient gene editing and maintain HSC viability and functionality, the D10A Cas9 variant protein was complexed to either modified HBB-8 gRNA or modified HBB-15 gRNA. The RNP complexes were mixed and electroporated (Amaxa Nucleofector) into CB CD34+ cells. Three days after electroporation, CD34+ cells were analyzed for gene editing using the T7E1 assay to analyze the HBB locus, and hematopoietic functionality ex vivo was assessed using the CFC assay. In cells electroporated with Cas9 RNP containing gRNAs with no 5' or 3' end modifications, no gene editing was detected by T7E1 assay analysis (FIG. 30A, left panel). In contrast, addition of either a 5' ARCA cap, a 3' polyA tail or varying lengths (i.e., 10A of 20A), or both a 5' cap and 3' poly(A) tail supported ~10% gene editing at the HBB locus. Cells treated using RNPs having gRNAs with a combination of a 5' ARCA cap and a 3' poly A tail of varying lengths (10A or 20A) end modifications exhibited increased gene editing (upto approximately 2.5-fold). For all cells, hematopoietic functionality was maintained regardless of the RNP complex used (FIG. 30B, right panel).

To validate these results, CD34+ cells from a different donor subject were electroporated with in vitro transcribed gRNAs HBB-8 and HBB-15 complexed to the Cas9 D10A variant protein. The gRNAs had a 3' 20A tail and either an unmodified 5' end (p(A)) or a 5' ARCA cap (C-p(A)). Substantial gene editing was observed using both types of gRNAs, as determined by DNA sequence analysis (FIG. 30B, left panel). The subtypes of editing events detected include insertions, deletions, and gene conversion. Differences in total gene editing frequency (35% and 47%) between the two gRNA treatment groups could not be attributed to the gRNA modification. Importantly, cells electroporated with D10A RNP complexes including gRNAs with both a 5' ARCA cap and 3' polyA tail had higher fold-change in the number of cells and colony forming potential, as compared to cells treated with RNP complexes including gRNAs solely containing 3' modified gRNAs (FIG. 30B, middle and right panels).

In order to confirm the synergistic effect, CB CD34+ cells were obtained from a different donor subject and the experiment above repeated. Cells treated with RNP complexes containing either gRNAs having a 3' poly(A) tail or gRNAs having a 5' ARCA cap and a 3' poly(A) tail had the highest level of gene editing frequency, while unmodified gRNAs had the lowest level of gene editing, followed by cells treated with RNP complexes solely containing 5' ARCA capped gRNAs (FIG. 30C, left panel). No significant difference in gene editing frequency was observed using RNP complexes containing gRNAs with a 3' poly(A) tail (20A) alone and RNP complexes containing gRNAs having a 5' CAP and a 3' polyA tail. However, analysis of hematopoietic activity (CFC potential) indicated that cells treated with RNP containing unmodified gRNAs or gRNAs modified at the 3' end alone also gave rise to fewer hematopoietic colonies (FIG. 30C, right panel). These data suggest that modification of gRNAs with a 5' ARCA cap and 3' poly(A) tail of a defined length (20A) supports gene editing in both adult and cord blood CD34+ cells while maintaining their fold change in the number of cells, viability, and hematopoietic potential ex vivo.

REFERENCES

Anders et al. *Nature* 513(7519):569-573 (2014); Bae et al. *Bioinformatics* 30(10):1473-1475 (2014); Baldridge et al. *Trends Immunol.* 32(2): 57-65 (2011); Beard et al. *J. Clin. Invest.* 120(7):2345-54 (2010); Blank et al. *Eur. J. Haematol.* 89:198-205 (2012); Boitano et al. *Science* 329: 1345-1348 (2010); Caldecott *Nat. Rev. Genet.* 9(8):619-631 (2008); Carlin et al. *Cytotherapy* 15: 224-230 (2013); Cong et al. *Science* 399(6121):819-823 (2013); Chylinski et al. *RNA Biol.* 10(5):726-737 (2013); Ciolino et al. *Cancer Res.* 58: 5707-12 (1998); Cutler et al. *Blood* 122 (17): 3074-3081 (2013); Delaney et al. *Nature Medicine* 16: 232-6 (2010); Delcroy et al. *Nature Reviews Microbiology* 10: 51-65 (2012); Deveau et al. *J. Bacteriol.* 190(4): 1390-1400 (2008); DiSio et al. *Blood* 107(11): 4257-4265 (2006); Di Stasi et al. *N. Engl. J. Med.* 365: 1673-1683 (2011); Esser *Arch. Toxicol.* 86: 1323-1329 (2012); Esvelt et al. *Nature* 472(7344): 499-503 (2011); Fan et al. *Stem Cell Res. Ther.* 5: 71-80 (2014); Fares et al. *Science* 345(6203): 1509-1512 (2014); Fleming et al., *Cell Stem Cell* 2(3): 274-283 (2008); Friedland et al. *Genome Biol.* 16:257 (2015); Fu et al. *Nat. Biotechnol.* 32:279-284 (2014); Gasiewicz et al. (1991) *Mol. Pharmacol.* 40: 607-12; Gori et al. *Cancer Gene Therapy* 19(8): 1523-9 (2012); Gu et al. *Human Gene Therapy Methods* 25(4): 221-231 (2014); Haft et al. *PLoS Computational Biology* 1(6): e60 (2005); Heigwer et al. *Nat. Methods* 11(2):122-3 (2014); Henry et al. *Mol. Pharmacol.* 55: 716-25 (1999); Horvath et al. *Science* 327(5962): 167-170 (2010); Hsu et al. *Nat. Biotechnol.* 31(9): 827-32 (2013); Hütter et al. *N. Engl. J. Med.* 360(7):692-698 (2009); Inman et al. *Mol. Pharmacol.* 62(1): 65-74 (2002); Jinek et al. *Science* 337(6096):816-821 (2012); Jinek et al. *Science* 343(6176):1247997 (2014); Kajaste-Rudnitski and Naldini *Human Gene Therapy* 26: 201-209 (2015); Lee et al. *Nano Lett.* 12(12):6322-6327 (2012); Li *Cell. Res.* 18(1):85-98 (2008); Lysakova-Devine et al. (2010) *J Immunol.* 185: 4261-4271; Luster et al. *Biochem Biophys Res Commun.* 139: 747-56 (1986); Makarova et al. *Nature Review Microbiology* 9:467-477 (2011); Mali et al. *Science* 399(6121): 823-826 (2013); Marteijn et al. *Nat. Rev. Mol. Cell. Biol.* 15(7):465-481 (2014); Merchant et al. *Arch. Biochem. Biophys.* 281: 84-9 (1990); Murray et al. *J. Pharmacol. Exp. Ther.* 332(1): 135-44 (2010); Nemeth et al. *Proc. Nat'l. Acad. Sci.* USA 104 (39): 15436-41 (2007); Nishimasu et al. *Cell* 156(5):935-949 (2014); Nitino et al. *Exp. Hematol.* 37(11): 1364-77 (2009); Petrillo et al. *Mol. Therapy* 23(2): 352-62 (2015); Poulos et al. *Cell Reports* 4(5): 1022-1034 (2013); Ran et al. *Cell* 154(6): 1380-1389 (2013); Pan et al. *Nat. Commun.* 6: 7096 (2015); Redman et al. *Mol. Immunol.* S0161-5890 (15): 00361-2 (2015); Singh et al. *Biochem. Pharmacol.* 77, 577-587 (2009); Smith et al. *J. Pharmacol. Exp. Ther.* 338: 318-27 (2011); Sternberg et al. *Nature* 507(7490):62-67 (2014); Suarez-Fariñas et al. *PLoS One* 8(12): e84634 (2013); Sugimura et al. *Cell* 150(2):351-365 (2012); Tamplin et al. *Cell* 160: 241-252 (2014); Tey et al. *Biol. Blood Marrow Transplant* 13(8):913-24 (2007); Thurmond et al. *Toxicol. Appl. Pharmacol.* 158: 33-40 (1999); Tsubuki et al. *J. Biochem.* 119: 572-6 (1996); Vancovi et al. *J. Gen. Virol.* 79 (Pt 7): 1647-9 (1998); Wang et al. *Cell* 153(4):910-918 (2013); Wang et al. *Blood* 124: 913-23 (2014); Xiao A. et al. *Bioinformatics* 30 (8):1180-1182 (2014); Yamazaki et al. *Cell* 147: 1146-1158 (2011); Zhou et al., *Nucleic Acids Res.* 42(3): e19 (2014)

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the disclosure described herein. Such equivalents are intended to be encompassed by the following claims.

SEQUENCE LISTING (512 sequences)

SEQ ID NO: 1 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  Synthetic oligonucleotide
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 7 - protein, 1368 aa, Streptococcus pyogenes [sequence omitted]

SEQ ID NO: 8 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (6)..(6): Xaa is Ser or Tyr or Asn or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXXXGXXXX

SEQ ID NO: 9 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXSXGXXXX

SEQ ID NO: 10 - protein, 12 aa, Artificial Sequence
  Synthetic peptide
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (11)..(11): Xaa is Val or Ile or Leu or Ala or Met or His
  VARIANT (12)..(12): Any amino acid or absent
DIGXXSVGWAXX

SEQ ID NO: 11 - protein, 12 aa, Artificial Sequence
  Synthetic peptide
  MOD_RES (12)..(12): Any non-polar alkyl amino acid or a hydroxyl amino acid
DIGTNSVGWAVX

SEQ ID NO: 12 - protein, 8 aa, Artificial Sequence
  Synthetic peptide
  VARIANT (2)..(2): Xaa is Val or His
  VARIANT (3)..(3): Xaa is Ile or Leu or Val
  VARIANT (5)..(5): Xaa is Met or Thr
IXXEXARE

SEQ ID NO: 13 - protein, 8 aa, Artificial Sequence
  Synthetic peptide
  VARIANT (3)..(3): Xaa is Ile or Leu or Val
IVXEMARE

SEQ ID NO: 14 - protein, 8 aa, Artificial Sequence
  Synthetic peptide
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 15 - protein, 8 aa, Artificial Sequence
  Synthetic peptide
HHAHDAYL

SEQ ID NO: 16 - protein, 30 aa, Artificial Sequence
  Synthetic polypeptide
  VARIANT (2)..(2): Xaa is Lys or Pro
  VARIANT (4)..(4): Xaa is Val or Leu or Ile or Phe
  VARIANT (5)..(5): Xaa is Gly or Ala or Ser
  VARIANT (6)..(6): Xaa is Leu or Ile or Val or Phe
  MOD_RES (7)..(26): Any amino acid and this region may encompass 5-20 residues wherein some positions may be absent
  VARIANT (29)..(29): Xaa is Asp or Glu or Asn or Gln
KXYXXXXXXXXXXXXXXXXXXXXXXXTDXY

SEQ ID NO: 17 - protein, 27 aa, Artificial Sequence
  Synthetic peptide
  VARIANT (1)..(1): Xaa is Asp or Glu or Gln or Asn
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (9)..(9): Xaa is Ser or Ala or Asp or Thr or Lys
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (13)..(13): Xaa is Asp or Ser or Asn or Arg or Leu or Thr
  VARIANT (14)..(14): Xaa is Asp or Asn or Ser
  VARIANT (15)..(15): Xaa is Ser or Ala or Thr or Gly or Arg
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (19)..(19): Xaa is Lys or Leu or Arg or Met or Thr or Phe
  VARIANT (20)..(20): Xaa is Val or Leu or Ile or Ala or Thr
  VARIANT (21)..(21): Xaa is Leu or Ile or Val or Ala
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XXXHXXPXXXXXXXXXXNXXXXXXXXN

SEQ ID NO: 18 - protein, 27 aa, Artificial Sequence
  Synthetic peptide
  VARIANT (1)..(1): Xaa is Asp or Glu
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys Met or Asp or Phe
XXXHXXPXSXXXDDSXXNKVLXXXXXN

SEQ ID NO: 19 - protein, 27 aa, Artificial Sequence
  Synthetic peptide
  VARIANT (1)..(1): Xaa is Asp or Glu
  VARIANT (3)..(3): Xaa is Asp or Glu
  VARIANT (8)..(8): Xaa is Gln or His or Arg or Lys or Tyr or Ile or Leu or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XVXHIVPXSXXXDDSXXNKVLTXXXXN

SEQ ID NO: 20 - protein, 27 aa, Artificial Sequence
  Synthetic peptide
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg or Lys or Leu
  VARIANT (22)..(22): Xaa is Thr or Val
  VARIANT (23)..(23): Xaa is Ser or Arg
  VARIANT (25)..(25): Xaa is Lys or Asp or Ala
  VARIANT (26)..(26): Xaa is Glu or Lys or Gly or Asn
DXDHIXPQXFXXDXSIDNXVLXXSXXN

SEQ ID NO: 21 - protein, 73 aa, Artificial Sequence
  Synthetic polypeptide
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu or Gln or Asp
  VARIANT (15)..(15): Xaa is Glu or Asp
  VARIANT (19)..(19): Xaa is Asp or Asn or His
  VARIANT (20)..(20): Xaa is Tyr or Arg or Asn
  VARIANT (23)..(23): Xaa is Gln or Asp or Asn
  MOD_RES (25)..(64): Any amino acid and this region may encompass 15-40 residues wherein some positions may be absent
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 22 - DNA, 4107 bp, Streptococcus pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - protein, 1368 aa, Streptococcus pyogenes [sequence omitted]

SEQ ID NO: 24 - DNA, 3249 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  Synthetic polynucleotide
  misc_feature (1)..(20): a, c, u, g, unknown or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  Synthetic polynucleotide
  misc_feature (1)..(20): a, c, u, g, unknown or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  Synthetic polynucleotide
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  Synthetic oligonucleotide
  misc_feature (1)..(20): a, c, u, g, unknown or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  Synthetic oligonucleotide
  misc_feature (1)..(20): a, c, u, g, unknown or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  Synthetic polynucleotide
  misc_feature (1)..(20): a, c, u, g, unknown or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  Synthetic oligonucleotide
aaggcuaguccguuaucaacuugaaaaaguggcaccgagucggugcu

SEQ ID NO: 34 - RNA, 49 nt, Artificial Sequence
  Synthetic oligonucleotide
aaggcuaguccguuaucaacuugaaaaaguggcaccgagucgguggugc

SEQ ID NO: 35 - RNA, 51 nt, Artificial Sequence
  Synthetic oligonucleotide
aaggcuaguccguuaucaacuugaaaaaguggcaccgagucggugcggauc

SEQ ID NO: 36 - RNA, 31 nt, Artificial Sequence
  Synthetic oligonucleotide
aaggcuaguccguuaucaacuugaaaaagug

SEQ ID NO: 37 - RNA, 18 nt, Artificial Sequence
  Synthetic oligonucleotide
aaggcuaguccguuauca

SEQ ID NO: 38 - RNA, 12 nt, Artificial Sequence
  Synthetic oligonucleotide
aaggcuaguccg

SEQ ID NO: 39 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40 - RNA, 102 nt, Artificial Sequence
  Synthetic oligonucleotide
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 41 - skipped

SEQ ID NO: 42 - RNA, 42 nt, Streptococcus pyogenes
  misc_feature (1)..(20): a, c, u, g, unknown or other
nnnnnnnnnnnnnnnnnnnnguuuuagagcuaugcuguuuug

SEQ ID NO: 43 - RNA, 85 nt, Streptococcus pyogenes
ggaaccauucaaaacagcauagcaaguuaaaauaaggcuaguccguuaucaacuugaaaaaguggcaccgagucggugcuuuuuu

SEQ ID NO: 44 - RNA, 62 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccg

SEQ ID NO: 45 - RNA, 102 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Streptococcus pyogenes
  misc_feature (1)..(20): a, c, u, g, unknown or other
nnnnnnnnnnnnnnnnnnnnguuuuagagcuaugcugaaaagcauagcaaguuaaaauaaggcuaguccguuauc

SEQ ID NO: 47 - RNA, 87 nt, Streptococcus pyogenes
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Streptococcus thermophilus
  misc_feature (1)..(20): a, c, u, g, unknown or other
nnnnnnnnnnnnnnnnnnnnguuuuagagcuguguuguuucg

SEQ ID NO: 49 - RNA, 78 nt, Streptococcus thermophilus
gggcgaaacaacacagcgaguuaaaauaaggcuuaguccguacucaacuugaaaagguggcaccgauucgguguuuuu

SEQ ID NO: 50 - RNA, 42 nt, Streptococcus pyogenes; identical to SEQ ID NO: 42
  misc_feature (1)..(20): a, c, u, g, unknown or other

SEQ ID NO: 51 - RNA, 42 nt, Streptococcus thermophilus; identical to SEQ ID NO: 48
  misc_feature (1)..(20): a, c, u, g, unknown or other

SEQ ID NO: 52 - RNA, 85 nt, Streptococcus pyogenes
gaaccauucaaaacagcauagcaaguuaaaauaaggcuaguccguuaucaacuugaaaaaguggcaccgagucggugcuuuuuuu

SEQ ID NO: 53 - RNA, 78 nt, Streptococcus thermophilus; identical to SEQ ID NO: 49

SEQ ID NO: 54 - protein, 12 aa, Artificial Sequence
  Synthetic peptide
DIGTNSVGWAVT

SEQ ID NO: 55 - protein, 12 aa, Artificial Sequence
  Synthetic peptide
DIGTNSVGWAVT

SEQ ID NO: 56 - protein, 12 aa, Artificial Sequence
  Synthetic peptide
DVGTNSVGWAVT

SEQ ID NO: 57 - protein, 12 aa, Artificial Sequence
  Synthetic peptide
DVGTNSVGWAVT

SEQ ID NO: 58 - protein, 12 aa, Artificial Sequence
  Synthetic peptide
DMGTNSVGWAVT

SEQ ID NO: 59 - protein, 12 aa, Artificial Sequence
  Synthetic peptide
DVGTSSVGWAVT

SEQ ID NO: 60 - protein, 12 aa, Artificial Sequence
  Synthetic peptide
DIGTASVGWAVT

SEQ ID NO: 61 - protein, 12 aa, Artificial Sequence
  Synthetic peptide
DVGTGSVGWAVT

SEQ ID NO: 62 - protein, 12 aa, Artificial Sequence
  Synthetic peptide
DIGTNSVGWAVV

SEQ ID NO: 63 - protein, 12 aa, Artificial Sequence
  Synthetic peptide
DIGTNSVGWAVI

SEQ ID NO: 64 - protein, 12 aa, Artificial Sequence
  Synthetic peptide
DIGTNSVGWAVL

SEQ ID NO: 65 - protein, 12 aa, Artificial Sequence
  Synthetic peptide
DLGTNSIGWAVV

SEQ ID NO: 66 - protein, 11 aa, Artificial Sequence
  Synthetic peptide
DLGTNSIGWAI

SEQ ID NO: 67 - protein, 12 aa, Artificial Sequence
  Synthetic peptide
DLGTNSIGWALV

SEQ ID NO: 68 - protein, 12 aa, Artificial Sequence
  Synthetic peptide
DIGTNSVGWCVT

SEQ ID NO: 69 - protein, 12 aa, Artificial Sequence
  Synthetic peptide
DIGTNSVGYAVT

SEQ ID NO: 70 - protein, 12 aa, Artificial Sequence
  Synthetic peptide
DMGTGSLGWAVT

SEQ ID NO: 71 - protein, 12 aa, Artificial Sequence
  Synthetic peptide
DIGTSSVGWAAI

SEQ ID NO: 72 - protein, 12 aa, Artificial Sequence
  Synthetic peptide
DLGTGSVGWAVV

SEQ ID NO: 73 - protein, 12 aa, Artificial Sequence
  Synthetic peptide
DLGVGSVGWAIV

SEQ ID NO: 74 - protein, 12 aa, Artificial Sequence
  Synthetic peptide
DLGIASIGWAII

SEQ ID NO: 75 - protein, 12 aa, Artificial Sequence
  Synthetic peptide
DLGIASVGWAIV

SEQ ID NO: 76 - protein, 12 aa, Artificial Sequence
  Synthetic peptide
DLGVASVGWSIV

SEQ ID NO: 77 - protein, 12 aa, Artificial Sequence
  Synthetic peptide
DIGIASVGWAIL

SEQ ID NO: 78 - protein, 12 aa, Artificial Sequence
  Synthetic peptide
DLGISSVGWSVI

SEQ ID NO: 79 - protein, 12 aa, Artificial Sequence
  Synthetic peptide
DIGIASVGWSVI

SEQ ID NO: 80 - protein, 12 aa, Artificial Sequence
  Synthetic peptide
DVGIGSIGWAVI

SEQ ID NO: 81 - protein, 12 aa, Artificial Sequence
  Synthetic peptide
DLGVGSIGFAIV

SEQ ID NO: 82 - protein, 12 aa, Artificial Sequence
  Synthetic peptide
DIGYASIGWAVI

SEQ ID NO: 83 - protein, 12 aa, Artificial Sequence
  Synthetic peptide
DTGTNSLGWAIV

SEQ ID NO: 84 - protein, 12 aa, Artificial Sequence
  Synthetic peptide
DLGTNSIGWCLL

SEQ ID NO: 85 - protein, 12 aa, Artificial Sequence
  Synthetic peptide
DIGTDSLGWAVF

SEQ ID NO: 86 - protein, 12 aa, Artificial Sequence
  Synthetic peptide
DIGSNSIGFAVV

SEQ ID NO: 87 - protein, 12 aa, Artificial Sequence
  Synthetic peptide
DLGVGSIGVAVA

SEQ ID NO: 88 - protein, 12 aa, Artificial Sequence
  Synthetic peptide
DLGIASCGWGVV

SEQ ID NO: 89 - protein, 12 aa, Artificial Sequence
  Synthetic peptide
DLGIASVGWCLT

SEQ ID NO: 90 - protein, 12 aa, Artificial Sequence
  Synthetic peptide
DIGIGSVGVGIL

SEQ ID NO: 91 - protein, 12 aa, Artificial Sequence
  Synthetic peptide
DIGITSVGYGLI

SEQ ID NO: 92 - protein, 12 aa, Artificial Sequence
  Synthetic peptide
DIGITSVGFGII

SEQ ID NO: 93 - protein, 12 aa, Artificial Sequence
  Synthetic peptide
DVGITSTGYAVL

SEQ ID NO: 94 - protein, 12 aa, Artificial Sequence
  Synthetic peptide
DLGITSFGYAIL

SEQ ID NO: 95 - protein, 12 aa, Artificial Sequence
  Synthetic peptide
DIGNASVGWSAF

SEQ ID NO: 96 - protein, 12 aa, Artificial Sequence
  Synthetic peptide
DVGTNSCGWVAM

SEQ ID NO: 97 - protein, 12 aa, Artificial Sequence
  Synthetic peptide
DVGERSIGLAAV

SEQ ID NO: 98 - protein, 12 aa, Artificial Sequence
  Synthetic peptide
DVGLNSVGLAAV

SEQ ID NO: 99 - protein, 12 aa, Artificial Sequence
  Synthetic peptide
DVGLMSVGLAAI

SEQ ID NO: 100 - protein, 12 aa, Artificial Sequence
  Synthetic peptide
DVGTFSVGLAAI

SEQ ID NO: 101 - protein, 12 aa, Artificial Sequence
  Synthetic peptide
DIGTGSVGYACM

SEQ ID NO: 102 - protein, 12 aa, Artificial Sequence
  Synthetic peptide
DLGTTSIGFAHI

SEQ ID NO: 103 - protein, 12 aa, Artificial Sequence
  Synthetic peptide
DLGTNSIGSSVR

SEQ ID NO: 104 - protein, 12 aa, Artificial Sequence
  Synthetic peptide
DIGTNSVGWAVT

SEQ ID NO: 105 - protein, 12 aa, Artificial Sequence
  Synthetic peptide
DIGTNSVGWAVT

SEQ ID NO: 106 - protein, 12 aa, Artificial Sequence
  Synthetic peptide
DVGTNSVGWAVT

SEQ ID NO: 107 - protein, 12 aa, Artificial Sequence
  Synthetic peptide
DVGTNSVGWAVT

SEQ ID NO: 108 - protein, 12 aa, Artificial Sequence
  Synthetic peptide
DMGTNSVGWAVT

SEQ ID NO: 109 - protein, 12 aa, Artificial Sequence
  Synthetic peptide
DVGTSSVGWAVT

SEQ ID NO: 110 - protein, 12 aa, Artificial Sequence
  Synthetic peptide
DIGTASVGWAVT

SEQ ID NO: 111 - protein, 12 aa, Artificial Sequence
  Synthetic peptide
DVGTGSVGWAVT

SEQ ID NO: 112 - protein, 12 aa, Artificial Sequence
  Synthetic peptide
DIGTNSVGWAVV

SEQ ID NO: 113 - protein, 12 aa, Artificial Sequence
  Synthetic peptide
DIGTNSVGWAVI

SEQ ID NO: 114 - protein, 12 aa, Artificial Sequence
  Synthetic peptide
DIGTNSIGWAVI

SEQ ID NO: 115 - protein, 12 aa, Artificial Sequence
  Synthetic peptide
DIGTNSVGWAVL

SEQ ID NO: 116 - protein, 12 aa, Artificial Sequence
  Synthetic peptide
DLGTNSIGWAVV

SEQ ID NO: 117 - protein, 11 aa, Artificial Sequence
  Synthetic peptide
DLGTNSIGWAI

SEQ ID NO: 118 - protein, 12 aa, Artificial Sequence
  Synthetic peptide
DLGTNSIGWALV

SEQ ID NO: 119 - protein, 12 aa, Artificial Sequence
  Synthetic peptide
DIGTNSVGWCVT

SEQ ID NO: 120 - protein, 12 aa, Artificial Sequence
  Synthetic peptide
DIGTNSVGYAVT

SEQ ID NO: 121 - protein, 12 aa, Artificial Sequence
  Synthetic peptide
DMGTGSLGWAVT

SEQ ID NO: 122 - protein, 12 aa, Artificial Sequence
  Synthetic peptide
DIGTSSVGWAAI

SEQ ID NO: 123 - protein, 12 aa, Artificial Sequence
  Synthetic peptide
DLGTGSVGWAVV

SEQ ID NO: 124 - protein, 12 aa, Artificial Sequence
  Synthetic peptide
DLGVGSVGWAIV

SEQ ID NO: 125 - protein, 12 aa, Artificial Sequence
  Synthetic peptide
DLGIASIGWAII

SEQ ID NO: 126 - protein, 12 aa, Artificial Sequence
  Synthetic peptide
DLGIASVGWAIV

SEQ ID NO: 127 - protein, 12 aa, Artificial Sequence
  Synthetic peptide
DLGIASVGWAVV

SEQ ID NO: 128 - protein, 12 aa, Artificial Sequence
  Synthetic peptide
DLGVASVGWSIV

SEQ ID NO: 129 - protein, 12 aa, Artificial Sequence
  Synthetic peptide
DIGIASVGWAIL

SEQ ID NO: 130 - protein, 12 aa, Artificial Sequence
  Synthetic peptide
DIGIASVGWAVL

SEQ ID NO: 131 - protein, 12 aa, Artificial Sequence
  Synthetic peptide
DIGIASIGWAVI

SEQ ID NO: 132 - protein, 12 aa, Artificial Sequence
  Synthetic peptide
DIGIASVGWAII

SEQ ID NO: 133 - protein, 12 aa, Artificial Sequence
  Synthetic peptide
DVGIASVGWAVI

SEQ ID NO: 134 - protein, 11 aa, Artificial Sequence
  Synthetic peptide
DIGIASVGWAL

SEQ ID NO: 135 - protein, 12 aa, Artificial Sequence
  Synthetic peptide
DIGIASVGWAMV

SEQ ID NO: 136 - protein, 12 aa, Artificial Sequence
  Synthetic peptide
DIGIASVGWSVI

SEQ ID NO: 137 - protein, 12 aa, Artificial Sequence
  Synthetic peptide
DLGISSVGWSVI

SEQ ID NO: 138 - protein, 12 aa, Artificial Sequence
  Synthetic peptide
DIGITSVGWAVI

SEQ ID NO: 139 - protein, 12 aa, Artificial Sequence
  Synthetic peptide
DVGIGSIGWAVI

SEQ ID NO: 140 - protein, 12 aa, Artificial Sequence
  Synthetic peptide
DLGISSLGWAIV

SEQ ID NO: 141 - protein, 12 aa, Artificial Sequence
  Synthetic peptide
DLGVGSIGFAIV

SEQ ID NO: 142 - protein, 12 aa, Artificial Sequence
  Synthetic peptide
DIGYASIGWAVI

SEQ ID NO: 143 - protein, 12 aa, Artificial Sequence
  Synthetic peptide
DLGTNSIGWCLL

SEQ ID NO: 144 - protein, 12 aa, Artificial Sequence
  Synthetic peptide
DLGTNSIGWGLL

SEQ ID NO: 145 - protein, 12 aa, Artificial Sequence
  Synthetic peptide
DTGTNSLGWAIV

SEQ ID NO: 146 - protein, 12 aa, Artificial Sequence
  Synthetic peptide
DIGTDSLGWAVF

SEQ ID NO: 147 - protein, 12 aa, Artificial Sequence
  Synthetic peptide
DLGSTSLGWAIF

SEQ ID NO: 148 - protein, 12 aa, Artificial Sequence
  Synthetic peptide
DIGISSIGWAFS

SEQ ID NO: 149 - protein, 12 aa, Artificial Sequence
  Synthetic peptide
DLGIASVGWCLT

SEQ ID NO: 150 - protein, 12 aa, Artificial Sequence
  Synthetic peptide
DLGIASCGWGVV

SEQ ID NO: 151 - protein, 12 aa, Artificial Sequence
  Synthetic peptide
DIGSNSIGFAVV

SEQ ID NO: 152 - protein, 12 aa, Artificial Sequence
  Synthetic peptide
DIGTTSIGFSVI

SEQ ID NO: 153 - protein, 12 aa, Artificial Sequence
  Synthetic peptide
DIGITSVGYGLI

SEQ ID NO: 154 - protein, 12 aa, Artificial Sequence
  Synthetic peptide
DIGITSVGFGII

SEQ ID NO: 155 - protein, 12 aa, Artificial Sequence
  Synthetic peptide
DLGTTSIGFAHI

SEQ ID NO: 156 - protein, 12 aa, Artificial Sequence
  Synthetic peptide
DIGIGSVGVGIL

SEQ ID NO: 157 - protein, 12 aa, Artificial Sequence
  Synthetic peptide
DLGVGSIGVAVA

SEQ ID NO: 158 - protein, 12 aa, Artificial Sequence
  Synthetic peptide
DVGITSTGYAVL

SEQ ID NO: 159 - protein, 12 aa, Artificial Sequence
  Synthetic peptide
DLGITSFGYAIL

SEQ ID NO: 160 - protein, 12 aa, Artificial Sequence
  Synthetic peptide
DIGTSSIGWWLY

SEQ ID NO: 161 - protein, 12 aa, Artificial Sequence
  Synthetic peptide
DLGSNSLGWFVT

SEQ ID NO: 162 - protein, 12 aa, Artificial Sequence
  Synthetic peptide
DLGANSLGWFVV

SEQ ID NO: 163 - protein, 12 aa, Artificial Sequence
  Synthetic peptide
DIGNASVGWSAF

SEQ ID NO: 164 - protein, 12 aa, Artificial Sequence
  Synthetic peptide
DVGTNSCGWVAM

SEQ ID NO: 165 - protein, 12 aa, Artificial Sequence
  Synthetic peptide
DVGERSIGLAAV

SEQ ID NO: 166 - protein, 12 aa, Artificial Sequence
  Synthetic peptide
DVGLNSVGLAAV

SEQ ID NO: 167 - protein, 12 aa, Artificial Sequence
  Synthetic peptide
DVGLMSVGLAAI

SEQ ID NO: 168 - protein, 12 aa, Artificial Sequence
  Synthetic peptide
DVGTFSVGLAAI

SEQ ID NO: 169 - protein, 12 aa, Artificial Sequence
  Synthetic peptide
DIGTGSVGYACM

SEQ ID NO: 170 - protein, 12 aa, Artificial Sequence
  Synthetic peptide
DLGTNSIGSSVR

SEQ ID NO: 171 - protein, 15 aa, Artificial Sequence
  Synthetic peptide
DIGLRIGITSCGWSI

SEQ ID NO: 172 - protein, 12 aa, Artificial Sequence
  Synthetic peptide
DMGAKYTGVFYA

SEQ ID NO: 173 - protein, 12 aa, Artificial Sequence
  Synthetic peptide
DLGGKNTGFFSF

SEQ ID NO: 174 - protein, 12 aa, Artificial Sequence
  Synthetic peptide
DLGVKNTGVFSA

SEQ ID NO: 175 - protein, 12 aa, Artificial Sequence
  Synthetic peptide
DLGAKFTGVALY

SEQ ID NO: 176 - protein, 12 aa, Artificial Sequence
  Synthetic peptide
DLGGKFTGVCLS

SEQ ID NO: 177 - protein, 12 aa, Artificial Sequence
  Synthetic peptide
DLGGTYTGTFIT

SEQ ID NO: 178 - protein, 28 aa, Artificial Sequence
  Synthetic peptide
YDIDHIYPRSLTKDDSFDNLVLCERTAN

SEQ ID NO: 179 - protein, 28 aa, Artificial Sequence
  Synthetic peptide
DIDHIYPRSKVIKDDSFDNLVLVLKNEN

SEQ ID NO: 180 - protein, 27 aa, Artificial Sequence
  Synthetic peptide
DRDHIYPQSKIKDDSIDNLVLVNKTYN

SEQ ID NO: 181 - protein, 27 aa, Artificial Sequence
  Synthetic peptide
DIDHIYPRSKIKDDSITNRVLVEKDIN

SEQ ID NO: 182 - protein, 27 aa, Artificial Sequence
  Synthetic peptide
DIDHIYPQSKIKDDSISNRVLVCSSCN

SEQ ID NO: 183 - protein, 27 aa, Artificial Sequence
  Synthetic peptide
DIDHIYPQSKTMDDSLNNRVLVKKNYN

SEQ ID NO: 184 - protein, 27 aa, Artificial Sequence
  Synthetic peptide
DQDHIYPKSKIYDDSLENRVLVKKNLN

SEQ ID NO: 185 - protein, 27 aa, Artificial Sequence
  Synthetic peptide
QIDHIVPQSLVKDDSFDNRVLVVPSEN

SEQ ID NO: 186 - protein, 27 aa, Artificial Sequence
  Synthetic peptide
DIDHIIPQAFIKDNSIDNRVLTSSKEN

SEQ ID NO: 187 - protein, 27 aa, Artificial Sequence
  Synthetic peptide
DIDHIIPQAFLKDNSIDNKVLVSSASN

SEQ ID NO: 188 - protein, 27 aa, Artificial Sequence
  Synthetic peptide
DIDHIIPQAYTKDNSLDNRVLVSNITN

SEQ ID NO: 189 - protein, 27 aa, Artificial Sequence
  Synthetic peptide
DIDHIVPQSFITDNSIDNLVLTSSAGN

SEQ ID NO: 190 - protein, 27 aa, Artificial Sequence
  Synthetic peptide
DVDHIVPQSFLKDDSIDNKVLTRSDKN

SEQ ID NO: 191 - protein, 27 aa, Artificial Sequence
  Synthetic peptide
NIDHIYPQSMVKDDSLDNKVLVQSEIN

SEQ ID NO: 192 - protein, 27 aa, Artificial Sequence
  Synthetic peptide
DIDHILPQSLIKDDSLDNRVLVNATIN

SEQ ID NO: 193 - protein, 27 aa, Artificial Sequence
  Synthetic peptide
DIDHILPQSFIKDDSLENRVLVKKAVN

SEQ ID NO: 194 - protein, 27 aa, Artificial Sequence
  Synthetic peptide
EVDHIFPRSFIKDDSIDNKVLVIKKMN

SEQ ID NO: 195 - protein, 27 aa, Artificial Sequence
  Synthetic peptide
EVDHIIPRSYIKDDSFENKVLVYREEN

SEQ ID NO: 196 - protein, 27 aa, Artificial Sequence
  Synthetic peptide
DIDHIIPQAVTQNDSIDNRVLVARAEN

SEQ ID NO: 197 - protein, 27 aa, Artificial Sequence
  Synthetic peptide
EIDHIIPYSISFDDSSSNKLLVLAESN

SEQ ID NO: 198 - protein, 27 aa, Artificial Sequence
  Synthetic peptide
EIDHIIPYSLCFDDSSANKVLVHKQSN

SEQ ID NO: 199 - protein, 27 aa, Artificial Sequence
  Synthetic peptide
DIDHIIPYSRSMDDSYSNKVLVLSGEN

SEQ ID NO: 200 - protein, 27 aa, Artificial Sequence
  Synthetic peptide
DIDHIIPYSKSMDDSFNNKVLCLAEEN

SEQ ID NO: 201 - protein, 27 aa, Artificial Sequence
  Synthetic peptide
EIDHIYPYSRSFDDSYMNKVLVFTKQN

SEQ ID NO: 202 - protein, 27 aa, Artificial Sequence
  Synthetic peptide
QIDHIYPYSRSMDDSYMNKVLVLTDEN

SEQ ID NO: 203 - protein, 27 aa, Artificial Sequence
  Synthetic peptide
EIDHIIPFSRSFDDSLSNKILVLGSEN

SEQ ID NO: 204 - protein, 27 aa, Artificial Sequence
  Synthetic peptide
EIDHALPFSRTWDDSFNNKVLVLGSEN

SEQ ID NO: 205 - protein, 27 aa, Artificial Sequence
  Synthetic peptide
EIDHALPFSRTWDDSFNNKVLVLASEN

SEQ ID NO: 206 - protein, 27 aa, Artificial Sequence
  Synthetic peptide
EIDHIIPISISLDDSINNKVLVLSKAN

SEQ ID NO: 207 - protein, 27 aa, Artificial Sequence
  Synthetic peptide
EVDHIIPISISLDDSITNKVLVTHREN

SEQ ID NO: 208 - protein, 27 aa, Artificial Sequence
  Synthetic peptide
QVDHALPYSRSYDDSKNNKVLVLTHEN

SEQ ID NO: 209 - protein, 27 aa, Artificial Sequence
  Synthetic peptide
EVDHILPLSITFDDSLANKVLVYATAN

SEQ ID NO: 210 - protein, 27 aa, Artificial Sequence
  Synthetic peptide
EIDHIIPRSISFDDARSNKVLVYRSEN

SEQ ID NO: 211 - protein, 27 aa, Artificial Sequence
  Synthetic peptide
EVDHIIPRSVSFDNSYHNKVLVKQSEN

SEQ ID NO: 212 - protein, 27 aa, Artificial Sequence
  Synthetic peptide
DIDHILPYSITFDDSFRNKVLVTSQEN

SEQ ID NO: 213 - protein, 27 aa, Artificial Sequence
  Synthetic peptide
EIDHILPRSRSADDSFANKVLCLARAN

SEQ ID NO: 214 - protein, 27 aa, Artificial Sequence
  Synthetic peptide
EIEHLLPFSLTLDDSMANKTVCFRQAN

SEQ ID NO: 215 - protein, 27 aa, Artificial Sequence
  Synthetic peptide
DIDHILPFSVSLDDSAANKVVCLREAN

SEQ ID NO: 216 - protein, 27 aa, Artificial Sequence
  Synthetic peptide
DIDHLIPFSISWDDSAANKVVCMRYAN

SEQ ID NO: 217 - protein, 27 aa, Artificial Sequence
  Synthetic peptide
DIDHILPVAMTLDDSPANKIICMRYAN

SEQ ID NO: 218 - protein, 27 aa, Artificial Sequence
  Synthetic peptide
DVDHILPYSRTLDDSFPNRTLCLREAN

SEQ ID NO: 219 - protein, 27 aa, Artificial Sequence
  Synthetic peptide
EIEHILPFSRTLDDSLNNRTVAMRRAN

SEQ ID NO: 220 - protein, 27 aa, Artificial Sequence
  Synthetic peptide
EVDHIIPYSISWDDSYTNKVLTSAKCN

SEQ ID NO: 221 - protein, 27 aa, Artificial Sequence
  Synthetic peptide
QVDHILPWSRFGDDSYLNKTLCTARSN

SEQ ID NO: 222 - protein, 27 aa, Artificial Sequence
  Synthetic peptide
QVDHILPFSKTLDDSFANKVLAQHDAN

SEQ ID NO: 223 - protein, 27 aa, Artificial Sequence
  Synthetic peptide
QIDHAFPLSRSLDDSQSNKVLCLTSSN

SEQ ID NO: 224 - protein, 27 aa, Artificial Sequence
  Synthetic peptide
DIDHIVPRSISFDDSFSNLVIVNKLDN

SEQ ID NO: 225 - protein, 27 aa, Artificial Sequence
  Synthetic peptide
EIEHIIPYSMSYDNSQANKILTEKAEN

SEQ ID NO: 226 - protein, 27 aa, Artificial Sequence
  Synthetic peptide
EIDHVIPYSKSADDSWFNKLLVKKSTN

SEQ ID NO: 227 - protein, 27 aa, Artificial Sequence
  Synthetic peptide
EMDHILPYSRSLDNGWHNRVLVHGKDN

SEQ ID NO: 228 - protein, 27 aa, Artificial Sequence
  Synthetic peptide
EVDHIVPYSLILDNTINNKALVYAEEN

SEQ ID NO: 229 - protein, 27 aa, Artificial Sequence
  Synthetic peptide
EIEHVIPQSLYFDDSFSNKVICEAEVN

SEQ ID NO: 230 - protein, 27 aa, Artificial Sequence
  Synthetic peptide
DIEHIIPQARLFDDSFSNKTLEARSVN

SEQ ID NO: 231 - protein, 27 aa, Artificial Sequence
  Synthetic peptide
EIEHIVPKARVFDDSFSNKTLTFHRIN

SEQ ID NO: 232 - protein, 28 aa, Artificial Sequence
  Synthetic peptide
DKDHIIPQSMKKDDSIINNLVLVNKNAN

SEQ ID NO: 233 - protein, 27 aa, Artificial Sequence
  Synthetic peptide
EVEHIWPRSRSFDNSPRNKTLCRKDVN

SEQ ID NO: 234 - protein, 27 aa, Artificial Sequence
  Synthetic peptide
IVNHIIPYNRSFDDTYHNRVLTLTETK

SEQ ID NO: 235 - protein, 27 aa, Artificial Sequence
  Synthetic peptide
DMEHTIPKSISFDNSDQNLTLCESYYN

SEQ ID NO: 236 - protein, 27 aa, Artificial Sequence
  Synthetic peptide
DIEHTIPRSAGGDSTKMNLTLCSSRFN

SEQ ID NO: 237 - protein, 27 aa, Artificial Sequence
  Synthetic peptide
DIEHTIPRSISQDNSQMNKTLCSLKFN

SEQ ID NO: 238 - protein, 27 aa, Artificial Sequence
  Synthetic peptide
DIDHVIPLARGGRDSLDNMVLCQSDAN

SEQ ID NO: 239 - protein, 27 aa, Artificial Sequence
  Synthetic peptide
DIEHLFPIAESEDNGRNNLVISHSACN

SEQ ID NO: 240 - protein, 27 aa, Artificial Sequence
  Synthetic peptide
DVDHIFPRDDTADNSYGNKVVAHRQCN

SEQ ID NO: 241 - protein, 27 aa, Artificial Sequence
  Synthetic peptide
DIEHIVPQSLGGLSTDYNTIVTLKSVN

SEQ ID NO: 242 - protein, 27 aa, Artificial Sequence
  Synthetic peptide
ELDHIVPRTDGGSNRHENLAITCGACN

SEQ ID NO: 243 - protein, 28 aa, Artificial Sequence
  Synthetic peptide
EMDHIVPRKGVGSTNTRTNFAAVCAECN

SEQ ID NO: 244 - protein, 28 aa, Artificial Sequence
  Synthetic peptide
EMDHIVPRKGVGSTNTRVNLAAACAACN

SEQ ID NO: 245 - protein, 28 aa, Artificial Sequence
  Synthetic peptide
EMDHIVPRAGQGSTNTRENLVAVCHRCN

SEQ ID NO: 246 - protein, 33 aa, Artificial Sequence
  Synthetic polypeptide
EIDHILPRSLIKDARGIVFNAEPNLIYASSRGN

SEQ ID NO: 247 - protein, 33 aa, Artificial Sequence
  Synthetic polypeptide
EIDHIIPRSLTGRTKKTVFNSEANLIYCSSKGN

SEQ ID NO: 248 - protein, 33 aa, Artificial Sequence
  Synthetic polypeptide
EIDHIIPRSLTLKKSESIYNSEVNLIFVSAQGN

SEQ ID NO: 249 - protein, 33 aa, Artificial Sequence
  Synthetic polypeptide
EIDHIYPRSLSKKHFGVIFNSEVNLIYCSSQGN

SEQ ID NO: 250 - protein, 33 aa, Artificial Sequence
  Synthetic polypeptide
EIDHILPRSHTLKIYGTVFNPEGNLIYVHQKCN

SEQ ID NO: 251 - protein, 30 aa, Artificial Sequence
  Synthetic polypeptide
ELDHIIPRSHKKYGTLNDEANLICVTRGDN

SEQ ID NO: 252 - protein, 27 aa, Artificial Sequence
  Synthetic peptide
ELEHIVPHSFRQSNALSSLVLTWPGVN

SEQ ID NO: 253 - protein, 28 aa, Artificial Sequence
  Synthetic peptide
YDIDHIYPRSLTKDDSFDNLVLCERTAN

SEQ ID NO: 254 - protein, 28 aa, Artificial Sequence
  Synthetic peptide
DIDHIYPRSKVIKDDSFDNLVLVLKNEN

SEQ ID NO: 255 - protein, 27 aa, Artificial Sequence
  Synthetic peptide
DRDHIYPQSKIKDDSIDNLVLVNKTYN

SEQ ID NO: 256 - protein, 27 aa, Artificial Sequence
  Synthetic peptide
DIDHIYPRSKIKDDSITNRVLVEKDIN

SEQ ID NO: 257 - protein, 27 aa, Artificial Sequence
  Synthetic peptide
DIDHIYPQSKIKDDSISNRVLVCSSCN

SEQ ID NO: 258 - protein, 27 aa, Artificial Sequence
  Synthetic peptide
DIDHIYPQSKTMDDSLNNRVLVKKNYN

SEQ ID NO: 259 - protein, 27 aa, Artificial Sequence
  Synthetic peptide
DQDHIYPKSKIYDDSLENRVLVKKNLN

SEQ ID NO: 260 - protein, 27 aa, Artificial Sequence
  Synthetic peptide
QIDHIVPQSLVKDDSFDNRVLVVPSEN

SEQ ID NO: 261 - protein, 27 aa, Artificial Sequence
  Synthetic peptide
DIDHIIPQAFIKDNSIDNRVLTSSKEN

SEQ ID NO: 262 - protein, 27 aa, Artificial Sequence
  Synthetic peptide
DIDHIIPQAFLKDNSIDNKVLVSSASN

SEQ ID NO: 263 - protein, 27 aa, Artificial Sequence
  Synthetic peptide
DIDHIIPQAYTKDNSLDNRVLVSNITN

SEQ ID NO: 264 - protein, 27 aa, Artificial Sequence
  Synthetic peptide
DIDHIVPQSFITDNSIDNLVLTSSAGN

SEQ ID NO: 265 - protein, 27 aa, Artificial Sequence
  Synthetic peptide
DVDHIVPQSFLKDDSIDNKVLTRSDKN

SEQ ID NO: 266 - protein, 27 aa, Artificial Sequence
  Synthetic peptide
NIDHIYPQSMVKDDSLDNKVLVQSEIN

SEQ ID NO: 267 - protein, 27 aa, Artificial Sequence
  Synthetic peptide
DIDHILPQSLIKDDSLDNRVLVNATIN

SEQ ID NO: 268 - protein, 27 aa, Artificial Sequence
  Synthetic peptide
DIDHILPQSFIKDDSLENRVLVKKAVN

SEQ ID NO: 269 - protein, 27 aa, Artificial Sequence
  Synthetic peptide
EVDHIFPRSFIKDDSIDNKVLVIKKMN

SEQ ID NO: 270 - protein, 27 aa, Artificial Sequence
  Synthetic peptide
EVDHIIPRSYIKDDSFENKVLVYREEN

SEQ ID NO: 271 - protein, 27 aa, Artificial Sequence
  Synthetic peptide
DIDHIIPQAVTQNDSIDNRVLVARAEN

SEQ ID NO: 272 - protein, 27 aa, Artificial Sequence
  Synthetic peptide
DIDHIVPRSISFDDSFSNLVIVNKLDN

SEQ ID NO: 273 - protein, 27 aa, Artificial Sequence
  Synthetic peptide
EIDHIIPYSISFDDSSSNKLLVLAESN

SEQ ID NO: 274 - protein, 27 aa, Artificial Sequence
  Synthetic peptide
EIDHIIPYSLCFDDSSANKVLVHKQSN

SEQ ID NO: 275 - protein, 27 aa, Artificial Sequence
  Synthetic peptide
EIDHIIPISISLDDSINNKVLVLSKAN

SEQ ID NO: 276 - protein, 27 aa, Artificial Sequence
  Synthetic peptide
EVDHIIPISISLDDSITNKVLVTHREN

SEQ ID NO: 277 - protein, 27 aa, Artificial Sequence
  Synthetic peptide
EVDHILPLSITFDDSLANKVLVYATAN

SEQ ID NO: 278 - protein, 27 aa, Artificial Sequence
  Synthetic peptide
EIDHIIPRSISFDDARSNKVLVYRSEN

SEQ ID NO: 279 - protein, 27 aa, Artificial Sequence
  Synthetic peptide
EVDHIIPRSVSFDNSYHNKVLVKQSEN

SEQ ID NO: 280 - protein, 27 aa, Artificial Sequence
  Synthetic peptide
EVDHIIPYSISWDDSYTNKVLTSAKCN

SEQ ID NO: 281 - protein, 27 aa, Artificial Sequence
  Synthetic peptide
DIDHIIPYSRSMDDSYSNKVLVLSGEN

SEQ ID NO: 282 - protein, 27 aa, Artificial Sequence
  Synthetic peptide
EIEHIIPYSMSYDNSQANKILTEKAEN

SEQ ID NO: 283 - protein, 27 aa, Artificial Sequence
  Synthetic peptide
EVDHIVPYSLILDNTINNKALVYAEEN

SEQ ID NO: 284 - protein, 27 aa, Artificial Sequence
  Synthetic peptide
EIDHVIPYSKSADDSWFNKLLVKKSTN

SEQ ID NO: 285 - protein, 27 aa, Artificial Sequence
  Synthetic peptide
EMDHILPYSRSLDNGWHNRVLVHGKDN

SEQ ID NO: 286 - protein, 27 aa, Artificial Sequence
  Synthetic peptide
EIEHVIPQSLYFDDSFSNKVICEAEVN

SEQ ID NO: 287 - protein, 27 aa, Artificial Sequence
  Synthetic peptide
DIEHIIPQARLFDDSFSNKTLEARSVN

SEQ ID NO: 288 - protein, 27 aa, Artificial Sequence
  Synthetic peptide
EIEHIVPKARVFDDSFSNKTLTFHRIN

SEQ ID NO: 289 - protein, 28 aa, Artificial Sequence
  Synthetic peptide
DKDHIIPQSMKKDDSIINNLVLVNKNAN

SEQ ID NO: 290 - protein, 27 aa, Artificial Sequence
  Synthetic peptide
QVDHILPWSRFGDDSYLNKTLCTARSN

SEQ ID NO: 291 - protein, 27 aa, Artificial Sequence
  Synthetic peptide
DIDHVIPLARGGRDSLDNMVLCQSDAN

SEQ ID NO: 292 - protein, 27 aa, Artificial Sequence
  Synthetic peptide
DMEHTIPKSISFDNSDQNLTLCESYYN

SEQ ID NO: 293 - protein, 27 aa, Artificial Sequence
  Synthetic peptide
DIEHTIPRSAGGDSTKMNLTLCSSRFN

SEQ ID NO: 294 - protein, 27 aa, Artificial Sequence
  Synthetic peptide
DIEHTIPRSISQDNSQMNKTLCSLKFN

SEQ ID NO: 295 - protein, 27 aa, Artificial Sequence
  Synthetic peptide
DIEHLFPIAESEDNGRNNLVISHSACN

SEQ ID NO: 296 - protein, 27 aa, Artificial Sequence
  Synthetic peptide
DVDHIFPRDDTADNSYGNKVVAHRQCN

SEQ ID NO: 297 - protein, 27 aa, Artificial Sequence
  Synthetic peptide
DIEHIVPQSLGGLSTDYNTIVTLKSVN

SEQ ID NO: 298 - protein, 27 aa, Artificial Sequence
  Synthetic peptide
ELDHIVPRTDGGSNRHENLAITCGACN

SEQ ID NO: 299 - protein, 28 aa, Artificial Sequence
  Synthetic peptide
EMDHIVPRKGVGSTNTRTNFAAVCAECN

SEQ ID NO: 300 - protein, 28 aa, Artificial Sequence
  Synthetic peptide
EMDHIVPRKGVGSTNTRVNLAAACAACN

SEQ ID NO: 301 - protein, 28 aa, Artificial Sequence
  Synthetic peptide
EMDHIVPRAGQGSTNTRENLVAVCHRCN

SEQ ID NO: 302 - protein, 27 aa, Artificial Sequence
  Synthetic peptide
ELEHIVPHSFRQSNALSSLVLTWPGVN

SEQ ID NO: 303 - DNA, 3333 bp, Artificial Sequence
  Synthetic polynucleotide
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304 - protein, 1053 aa, Staphylococcus aureus; identical to SEQ ID NO: 26

SEQ ID NO: 305 - protein, 1368 aa, Streptococcus pyogenes [sequence omitted]

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 324 - protein, 1368 aa, Streptococcus pyogenes [sequence omitted]

SEQ ID NO: 325 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - protein, 1082 aa, Neisseria meningitidis; identical to SEQ ID NO: 25

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Unknown
  Uncultured delta polypeptide
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - RNA, 20 nt, Artificial Sequence
  Synthetic
aaggugaacguggaugaagu

SEQ ID NO: 388 - RNA, 20 nt, Artificial Sequence
  Synthetic
guaacggcagacuucuccuc

SEQ ID NO: 389 - RNA, 20 nt, Artificial Sequence
  Synthetic
guaacggcagacuucuccuc

SEQ ID NO: 390 - RNA, 20 nt, Artificial Sequence
  Synthetic
aaggugaacguggaugaagu

SEQ ID NO: 391-481 - skipped (91 entries)

SEQ ID NO: 482 - DNA, 3159 bp, Artificial Sequence
  Synthetic
atgaagcggaactacatcctgggcctggacatcggcatcaccagcgtgggctacggcatcatcgactacgagacacgggacgtgatcgatgccggcgtgcggctgttcaaagaggccaacgtggaaaacaacgagggcaggcggagcaagagaggcgccagaaggctgaagcggcggaggcggcatagaatccagagagtgaagaagctgctgttcgactacaacctgctgaccgaccacagcgagctgagcggcatcaacccctacgaggccagagtgaagggcctgagccagaagctgagcgaggaagagttctctgccgccctgctgcacctggccaagagaagaggcgtgcacaacgtgaacgaggtggaagaggacaccggcaacgagctgtccaccaaagagcagatcagccggaacagcaaggccctggaagagaaatacgtggccgaactgcagctggaacggctgaagaaagacggcgaagtgcggggcagcatcaacagattcaagaccagcgactacgtgaaagaagccaaacagctgctgaaggtgcagaaggcctaccaccagctggaccagagcttcatcgacacctacatcgacctgctggaaacccggcggacctactatgagggacctggcgagggcagccccttcggctggaaggacatcaaagaatggtacgagatgctgatgggccactgcacctacttccccgaggaactgcggagcgtgaagtacgcctacaacgccgacctgtacaacgccctgaacgacctgaacaatctcgtgatcaccagggacgagaacgagaagctggaatattacgagaagttccagatcatcgagaacgtgttcaagcagaagaagaagcccaccctgaagcagatcgccaaagaaatcctcgtgaacgaagaggatattaagggctacagagtgaccagcaccggcaagcccgagttcaccaacctgaaggtgtaccacgacatcaaggacattaccgcccggaaagagattattgagaacgccgagctgctggatcagattgccaagatcctgaccatctaccagagcagcgaggacatccaggaagaactgaccaatctgaactccgagctgacccaggaagagatcgagcagatctctaatctgaagggctataccggcacccacaacctgagcctgaaggccatcaacctgatcctggacgagctgtggcacaccaacgacaaccagatcgctatcttcaaccggctgaagctggtgcccaagaaggtggacctgtcccagcagaaagagatccccaccaccctggtggacgacttcatcctgagccccgtcgtgaagagaagcttcatccagagcatcaaagtgatcaacgccatcatcaagaagtacggcctgcccaacgacatcattatcgagctggcccgcgagaagaactccaaggacgcccagaaaatgatcaacgagatgcagaagcggaaccggcagaccaacgagcggatcgaggaaatcatccggaccaccggcaaagagaacgccaagtacctgatcgagaagatcaagctgcacgacatgcaggaaggcaagtgcctgtacagcctggaagccatccctctggaagatctgctgaacaaccccttcaactatgaggtggaccacatcatccccagaagcgtgtccttcgacaacagcttcaacaacaaggtgctcgtgaagcaggaagaaaacagcaagaagggcaaccggaccccattccagtacctgagcagcagcgacagcaagatcagctacgaaaccttcaagaagcacatcctgaatctggccaagggcaagggcagaatcagcaagaccaagaaagagtatctgctggaagaacgggacatcaacaggttctccgtgcagaaagacttcatcaaccggaacctggtggataccagatacgccaccagaggcctgatgaacctgctgcggagctacttcagagtgaacaacctggacgtgaaagtgaagtccatcaatggcggcttcaccagctttctgcggcggaagtggaagtttaagaaagagcggaacaaggggtacaagcaccacgccgaggacgccctgatcattgccaacgccgatttcatcttcaaagagtggaagaaactggacaaggccaaaaaagtgatggaaaaccagatgttcgaggaaaagcaggccgagagcatgcccgagatcgaaaccgagcaggagtacaaagagatcttcatcaccccccaccagatcaagcacattaaggacttcaaggactacaagtacagccaccgggtggacaagaagcctaatagagagctgattaacgacaccctgtactccacccggaaggacgacaagggcaacaccctgatcgtgaacaatctgaacggcctgtacgacaaggacaatgacaagctgaaaaagctgatcaacaagagccccgaaaagctgctgatgtaccaccacgacccccagacctaccagaaactgaagctgattatggaacagtacggcgacgagaagaatcccctgtacaagtactacgaggaaaccgggaactacctgaccaagtactccaaaaaggacaacggccccgtgatcaagaagattaagtattacggcaacaaactgaacgcccatctggacatcaccgacgactaccccaacagcagaaacaaggtcgtgaagctgtccctgaagccctacagattcgacgtgtacctggacaatggcgtgtacaagttcgtgaccgtgaagaatctggatgtgatcaaaaaagaaaactactacgaagtgaatagcaagtgctatgaggaagctaagaagctgaagaagatcagcaaccaggccgagtttatcgcctccttctacaacaacgatctgatcaagatcaacggcgagctgtatagagtgatcggcgtgaacaacgacctgctgaaccggatcgaagtgaacatgatcgacatcacctaccgcgagtacctggaaaacatgaacgacaagaggccccccaggatcattaagacaatcgcctccaagacccagagcattaagaagtacagcacagacattctgggcaacctgtatgaagtgaaatctaagaagcaccctcagatcatcaaaaagggc

SEQ ID NO: 483 - DNA, 3159 bp, Artificial Sequence
  Synthetic
atgaagcgcaactacatcctcggactggacatcggcattacctccgtgggatacggcatcatcgattacgaaactagggatgtgatcgacgctggagtcaggctgttcaaagaggcgaacgtggagaacaacgaggggcggcgctcaaagaggggggcccgccggctgaagcgccgccgcagacatagaatccagcgcgtgaagaagctgctgttcgactacaaccttctgaccgaccactccgaactttccggcatcaacccatatgaggctagagtgaagggattgtcccaaaagctgtccgaggaagagttctccgccgcgttgctccacctcgccaagcgcaggggagtgcacaatgtgaacgaagtggaagaagataccggaaacgagctgtccaccaaggagcagatcagccggaactccaaggccctggaagagaaatacgtggcggaactgcaactggagcggctgaagaaagacggagaagtgcgcggctcgatcaaccgcttcaagacctcggactacgtgaaggaggccaagcagctcctgaaagtgcaaaaggcctatcaccaacttgaccagtcctttatcgatacctacatcgatctgctcgagactcggcggacttactacgagggtccaggggagggctccccatttggttggaaggatattaaggagtggtacgaaatgctgatgggacactgcacatacttccctgaggagctgcggagcgtgaaatacgcatacaacgcagacctgtacaacgcgctgaacgacctgaacaatctcgtgatcacccgggacgagaacgaaaagctcgagtattacgaaaagttccagattattgagaacgtgttcaaacagaagaagaagccgacactgaagcagattgccaaggaaatcctcgtgaacgaagaggacatcaagggctatcgagtgacctcaacgggaaagccggagttcaccaatctgaaggtctaccacgacatcaaagacattaccgcccggaaggagatcattgagaacgcggagctgttggaccagattgcgaagattctgaccatctaccaatcctccgaggatattcaggaagaactcaccaacctcaacagcgaactgacccaggaggagatagagcaaatctccaacctgaagggctacaccggaactcataacctgagcctgaaggccatcaacttgatcctggacgagctgtggcacaccaacgataaccagatcgctattttcaatcggctgaagctggtccccaagaaagtggacctctcacaacaaaaggagatccctactacccttgtggacgatttcattctgtcccccgtggtcaagagaagcttcatacagtcaatcaaagtgatcaatgccattatcaagaaatacggtctgcccaacgacattatcattgagctcgcccgcgagaagaactcgaaggacgcccagaagatgattaacgaaatgcagaagaggaaccgacagactaacgaacggatcgaagaaatcatccggaccaccgggaaggaaaacgcgaagtacctgatcgaaaagatcaagctccatgacatgcaggaaggaaagtgtctgtactcgctggaggccattccgctggaggacttgctgaacaacccttttaactacgaagtggatcatatcattccgaggagcgtgtcattcgacaattccttcaacaacaaggtcctcgtgaagcaggaggaaaactcgaagaagggaaaccgcacgccgttccagtacctgagcagcagcgactccaagatttcctacgaaaccttcaagaagcacatcctcaacctggcaaaggggaagggtcgcatctccaagaccaagaaggaatatctgctggaagaaagagacatcaacagattctccgtgcaaaaggacttcatcaaccgcaacctcgtggatactagatacgctactcggggtctgatgaacctcctgagaagctactttagagtgaacaatctggacgtgaaggtcaagtcgattaacggaggtttcacctccttcctgcggcgcaagtggaagttcaagaaggaacggaacaagggctacaagcaccacgccgaggacgccctgatcattgccaacgccgacttcatcttcaaagaatggaagaaacttgacaaggctaagaaggtcatggaaaaccagatgttcgaagaaaagcaggccgagtctatgcctgaaatcgagactgaacaggagtacaaggaaatctttattacgccacaccagatcaaacacatcaaggatttcaaggattacaagtactcacatcgcgtggacaaaaagccgaacagggaactgatcaacgacaccctctactccacccggaaggatgacaaagggaataccctcatcgtcaacaaccttaacggcctgtacgacaaggacaacgataagctgaagaagctcattaacaagtcgcccgaaaagttgctgatgtaccaccacgaccctcagacttaccagaagctcaagctgatcatggagcagtatggggacgagaaaaacccgttgtacaagtactacgaagaaactgggaattatctgactaagtactccaagaaagataacggccccgtgattaagaagattaagtactacggcaacaagctgaacgcccatctggacatcaccgatgactaccctaattcccgcaacaaggtcgtcaagctgagcctcaagccctaccggtttgatgtgtaccttgacaatggagtgtacaagttcgtgactgtgaagaaccttgacgtgatcaagaaggagaactactacgaagtcaactccaagtgctacgaggaagcaaagaagttgaagaagatctcgaaccaggccgagttcattgcctccttctataacaacgacctgattaagatcaacggcgaactgtaccgcgtcattggcgtgaacaacgatctcctgaaccgcatcgaagtgaacatgatcgacatcacttaccgggaatacctggagaatatgaacgacaagcgcccgccccggatcattaagactatcgcctcaaagacccagtcgatcaagaagtacagcaccgacatcctgggcaacctgtacgaggtcaaatcgaagaagcacccccagatcatcaagaaggga

SEQ ID NO: 484 - DNA, 3159 bp, Artificial Sequence
  Synthetic
atgaaaaggaactacattctggggctggccatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 485 - DNA, 3159 bp, Artificial Sequence
  Synthetic
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagaggcctctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 486 - DNA, 20 bp, Artificial Sequence
  Synthetic
gtaacggcagacttctcctc

SEQ ID NO: 487 - DNA, 65 bp, Artificial Sequence
  Synthetic
caccgctagctaatacgactcactatagtaacggcagacttctcctcgttttagagctagaaata

SEQ ID NO: 488 - DNA, 20 bp, Artificial Sequence
  Synthetic
aaggtgaacgtggatgaagt

SEQ ID NO: 489 - DNA, 18 bp, Artificial Sequence
  Synthetic
taatacgactcactatag

SEQ ID NO: 490 - DNA, 17 bp, Artificial Sequence
  Synthetic
taatacgactcactata

SEQ ID NO: 491 - RNA, 17 nt, Artificial Sequence
  Synthetic
gcgcuucugguggcccu

SEQ ID NO: 492 - RNA, 22 nt, Artificial Sequence
  Synthetic
gcuccaaggaaagcauagagga

SEQ ID NO: 493 - RNA, 20 nt, Artificial Sequence
  Synthetic
gcugccgcccagugggacuu

SEQ ID NO: 494 - RNA, 20 nt, Artificial Sequence
  Synthetic
guccccuccaccccacagug

SEQ ID NO: 495 - RNA, 22 nt, Artificial Sequence
  Synthetic
gccuauaaaauagagcccuguc

SEQ ID NO: 496 - RNA, 22 nt, Artificial Sequence
  Synthetic
auacagucaguaucaauucugg

SEQ ID NO: 497 - RNA, 20 nt, Artificial Sequence
  Synthetic
guggugacaagugugaucac

SEQ ID NO: 498 - RNA, 24 nt, Artificial Sequence
  Synthetic
ccauacagucaguaucaauucugg

SEQ ID NO: 499 - RNA, 24 nt, Artificial Sequence
  Synthetic
aagccuauaaaauagagcccuguc

SEQ ID NO: 500 - RNA, 24 nt, Artificial Sequence
  Synthetic
ugggguggugacaagugugaucac

SEQ ID NO: 501 - RNA, 22 nt, Artificial Sequence
  Synthetic
ggguggugacaagugugaucac

SEQ ID NO: 502 - RNA, 18 nt, Artificial Sequence
  Synthetic
ggugacaagugugaucac

SEQ ID NO: 503 - RNA, 22 nt, Artificial Sequence
  Synthetic
gccuuuugcaguuuaucaggau

SEQ ID NO: 504 - RNA, 24 nt, Artificial Sequence
  Synthetic
gcucuauuuuauaggcuucuucuc

SEQ ID NO: 505 - RNA, 24 nt, Artificial Sequence
  Synthetic
gcucuucagccuuuugcaguuuau

SEQ ID NO: 506 - DNA, 5 bp, S. thermophilus
  misc_feature (1)..(1): n is a, c, g, or t
  misc_feature (4)..(4): n is a, c, g, or t
nggng

SEQ ID NO: 507 - DNA, 7 bp, S. thermophilus
  misc_feature (1)..(2): n is a, c, g, or t
nnagaaw

SEQ ID NO: 508 - DNA, 4 bp, S. mutans
  misc_feature (1)..(1): n is a, c, g, or t
naar

SEQ ID NO: 509 - DNA, 5 bp, S. aureus
  misc_feature (1)..(2): n is a, c, g, or t
nngrr

SEQ ID NO: 510 - DNA, 6 bp, S. aureus
  misc_feature (1)..(2): n is a, c, g, or t
  misc_feature (6)..(6): n is a, c, g, or t
nngrrn

SEQ ID NO: 511 - DNA, 6 bp, Artificial Sequence
  Synthetic
  misc_feature (1)..(2): n is a, c, g, or t
nngrrt

SEQ ID NO: 512 - DNA, 6 bp, Artificial Sequence
  Synthetic
  misc_feature (1)..(2): n is a, c, g, or t
nngrrv

What is claimed is:

1. An ex vivo or in vitro method of making a modified CD34+ stem cell for transplantation, comprising:
   (a) contacting a CD34+ stem cell with a stem cell viability enhancer for a period of fewer than 120 hours, wherein the stem cell does not expand, and wherein the stem cell viability enhancer is selected from the group consisting of rapamycin and UM171; and
   (b) contacting the CD34+ stem cell with a gRNA molecule and a Cas9 molecule in the absence of the stem cell viability enhancer, thereby generating a modified CD34+ stem cell and wherein contacting the CD34+ stem cell with the stem cell viability enhancer in step (a) promotes gene editing.

2. The method of claim 1, wherein the step of contacting the cell with the gRNA molecule and the Cas9 molecule is performed using electroporation.

3. The method of claim 2, further comprising cold-shocking the cell before electroporation and/or after electroporation.

4. The method of claim 1, wherein the cell is contacted with the stem cell viability enhancer for a period of about 72 hours.

5. The method of claim 1, wherein the cell is contacted with the stem cell viability enhancer for a period of about 24-48 hours.

6. The method of claim 1, further comprising
   (c) contacting the cell with the stem cell viability enhancer for a period of fewer than 72 hours after step (b).

7. The method of claim 1, wherein the stem cell viability enhancer inhibits differentiation, inhibits programmed cell death, inhibits senescence, or inhibits an innate immune response of the cell.

8. The method of claim 7, wherein the stem cell viability enhancer inhibits programmed cell death by inhibiting autophagy or apoptosis.

9. The method of claim 1, further comprising transferring the modified cell to a subject, wherein the cell engrafts into a target tissue of the subject.

10. The method of any one of claim 9, wherein the target tissue is peripheral blood, bone marrow, or spleen.

11. The method of claim 1, wherein the stem cell is selected from the group consisting of a myeloid progenitor cell, a lymphoid progenitor cell, a multipotent progenitor cell, a lineage restricted progenitor cell, or a mesenchymal stromal cell.

12. The method of claim 1, further comprising culturing the cell in a medium after step (b), wherein the medium comprises one or more of a cytokine, a basic fibroblast growth factor (bFGF), a vascular endothelial growth factor (VEGF), a Notch signaling modulator, a TGF-β signaling modulator, insulin-like growth factor-binding protein 1 (IGFBP1), insulin-like growth factor binding protein 2 (IGFBP2), insulin-like growth factor 1, insulin-like growth factor 2 (IGF2), insulin-like growth factor 3 (IGF3), an angiopoietin (ANG1), an angiopoietin-like protein (ANGPTL4), a SDF1/CXCR4 axis modulator, a Wnt signaling modulator, or combinations thereof.

13. The method of claim 12, wherein the medium comprises one or more cytokines selected from the group consisting of stem cell factor (SCF), thrombopoietin (TPO), Flt-3 ligand (FL), interleukin-6 (IL-6), and interleukin-11 (IL-11).

14. The method of claim 1, wherein the Cas9 molecule is a Cas9 polypeptide.

15. The method of claim 14, wherein the gRNA molecule and the Cas9 polypeptide are associated in a pre-formed ribonucleoprotein complex.

16. The method of claim 1, wherein the cell is contacted with the stem cell viability enhancer for a period of about 20, 15, 10, or 5 hours.

* * * * *